(12) United States Patent
Bryson et al.

(10) Patent No.: US 12,133,884 B2
(45) Date of Patent: Nov. 5, 2024

(54) METHODS OF SUBSTITUTING PATHOGENIC AMINO ACIDS USING PROGRAMMABLE BASE EDITOR SYSTEMS

(71) Applicant: Beam Therapeutics Inc., Cambridge, MA (US)

(72) Inventors: David Bryson, Cambridge, MA (US); John Evans, Cambridge, MA (US); Michael Packer, Cambridge, MA (US); Yanfang Fu, Cambridge, MA (US); Nicole Gaudelli, Cambridge, MA (US); Jason Michael Gehrke, Cambridge, MA (US); J. Keith Joung, Cambridge, MA (US)

(73) Assignee: Beam Therapeutics Inc., Cambridge, MA (US)

( * ) Notice: Subject to any disclaimer, the term of this patent is extended or adjusted under 35 U.S.C. 154(b) by 994 days.

(21) Appl. No.: 17/054,424

(22) PCT Filed: May 11, 2019

(86) PCT No.: PCT/US2019/031897
§ 371 (c)(1),
(2) Date: Nov. 10, 2020

(87) PCT Pub. No.: WO2019/217942
PCT Pub. Date: Nov. 14, 2019

(65) Prior Publication Data
US 2022/0401530 A1 Dec. 22, 2022

Related U.S. Application Data

(60) Provisional application No. 62/780,890, filed on Dec. 17, 2018, provisional application No. 62/670,539, filed on May 11, 2018, provisional application No. 62/670,521, filed on May 11, 2018.

(51) Int. Cl.
| | |
|---|---|
| A61K 38/50 | (2006.01) |
| A61K 31/7088 | (2006.01) |
| A61K 38/46 | (2006.01) |
| C07K 14/805 | (2006.01) |
| C12N 9/22 | (2006.01) |
| C12N 9/78 | (2006.01) |
| C12N 15/10 | (2006.01) |
| C12N 15/11 | (2006.01) |
| C12N 15/113 | (2010.01) |
| C12N 15/90 | (2006.01) |

(52) U.S. Cl.
CPC .......... *A61K 38/50* (2013.01); *A61K 31/7088* (2013.01); *A61K 38/465* (2013.01); *C12N 9/22* (2013.01); *C12N 9/78* (2013.01); *C12N 15/102* (2013.01); *C12N 15/11* (2013.01); *C12N 15/907* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | |
|---|---|---|
| 6,479,299 B1 | 11/2002 | Parce et al. |
| 6,586,192 B1 | 7/2003 | Peschle et al. |
| 6,989,248 B2 | 1/2006 | Longley |
| 7,101,710 B2 | 9/2006 | Tsai et al. |
| 7,576,186 B2 | 8/2009 | Lum et al. |
| 7,862,810 B2 | 1/2011 | Anversa |
| 7,910,315 B2 | 3/2011 | Modiano et al. |
| 8,518,716 B2 | 8/2013 | Hubel et al. |
| 8,552,157 B2 | 10/2013 | Amatulli et al. |
| 8,568,286 B2 | 10/2013 | Sih et al. |
| 8,999,641 B2 | 4/2015 | Zhang et al. |
| 9,068,179 B1 | 6/2015 | Liu et al. |
| 9,322,037 B2 | 4/2016 | Liu et al. |
| 9,388,430 B2 | 7/2016 | Liu et al. |
| 9,512,446 B1 | 12/2016 | Joung et al. |
| RE46,379 E | 4/2017 | Chen-Kiang et al. |
| 9,737,604 B2 | 8/2017 | Liu et al. |
| 9,816,998 B2 | 11/2017 | Lyden et al. |
| 9,840,699 B2 | 12/2017 | Liu et al. |
| 10,072,091 B2 | 9/2018 | Weissman et al. |
| 10,111,966 B2 | 10/2018 | Nixon et al. |
| 10,113,163 B2 | 10/2018 | Liu et al. |

(Continued)

FOREIGN PATENT DOCUMENTS

| | | |
|---|---|---|
| CN | 103088008 A | 5/2013 |
| CN | 104284669 A | 1/2015 |

(Continued)

OTHER PUBLICATIONS

Kleinstiver et al. (Engineered CRISPR-Cas9 nucleases with altered PAM specificities, Nature. Jul. 23, 2015; 523(7561): 481-485).*

(Continued)

*Primary Examiner* — Suzanne M Noakes
*Assistant Examiner* — Jae W Lee
(74) *Attorney, Agent, or Firm* — Melissa Hunter-Ensor; Nicholas Ballor; Greenberg Traurig, LLP

(57) ABSTRACT

Provided herein are compositions and methods of using base editors comprising a polynucleotide programmable nucleotide binding domain and a nucleobase editing domain in conjunction with a guide polynucleotide. Also provided herein are base editor systems for editing nucleobases of target nucleotide sequences.

4 Claims, 21 Drawing Sheets

Specification includes a Sequence Listing.

(56) References Cited

U.S. PATENT DOCUMENTS

| | | |
|---|---|---|
| 10,167,457 B2 | 1/2019 | Liu et al. |
| 10,191,055 B2 | 1/2019 | Vyas et al. |
| 10,465,176 B2 | 11/2019 | Liu et al. |
| 10,466,244 B2 | 11/2019 | Pillai et al. |
| 10,570,207 B2 | 2/2020 | Scadden et al. |
| 10,624,973 B2 | 4/2020 | Nixon et al. |
| 10,682,410 B2 | 6/2020 | Liu et al. |
| 10,697,967 B2 | 6/2020 | Liu et al. |
| 10,699,096 B2 | 6/2020 | Yang |
| 10,745,677 B2 | 8/2020 | Maianti et al. |
| 10,767,175 B2 | 9/2020 | Dellinger et al. |
| 10,849,924 B2 | 12/2020 | Goligorsky et al. |
| 10,874,710 B2 | 12/2020 | Van Dongen et al. |
| 10,882,915 B2 | 1/2021 | Pearse et al. |
| 10,899,843 B2 | 1/2021 | Pearse et al. |
| 10,947,530 B2 | 3/2021 | Liu et al. |
| 11,053,481 B2 | 7/2021 | Liu et al. |
| 11,124,782 B2 | 9/2021 | Liu et al. |
| 11,142,760 B2 | 10/2021 | Slaymaker et al. |
| 11,155,803 B2 | 10/2021 | Gaudelli et al. |
| 11,193,123 B2 | 12/2021 | Halperin |
| 11,214,780 B2 | 1/2022 | Liu et al. |
| 11,268,082 B2 | 3/2022 | Liu et al. |
| 11,319,532 B2 | 5/2022 | Liu et al. |
| 11,344,609 B2 | 5/2022 | Slaymaker et al. |
| 11,359,211 B2 | 6/2022 | Church et al. |
| 11,473,108 B2 | 10/2022 | Doudna et al. |
| 11,479,767 B2 | 10/2022 | Smith et al. |
| 11,542,496 B2 | 1/2023 | Liu et al. |
| 11,752,202 B2 | 9/2023 | Slaymaker et al. |
| 2003/0175973 A1 | 9/2003 | Spence et al. |
| 2004/0003420 A1 | 1/2004 | Kuhn et al. |
| 2004/0005623 A1 | 1/2004 | Longley |
| 2004/0115184 A1 | 6/2004 | Smith et al. |
| 2005/0003529 A1 | 1/2005 | Taniguchi et al. |
| 2005/0032122 A1 | 2/2005 | Hwang et al. |
| 2005/0124896 A1 | 6/2005 | Richter et al. |
| 2005/0187607 A1 | 8/2005 | Akhtar et al. |
| 2005/0222030 A1 | 10/2005 | Allison |
| 2007/0071714 A1 | 3/2007 | Zsebo et al. |
| 2007/0254319 A1 | 11/2007 | Donnenberg et al. |
| 2008/0152652 A1 | 6/2008 | Besmer et al. |
| 2008/0248503 A1 | 10/2008 | Rich |
| 2009/0075381 A1 | 3/2009 | Clarke et al. |
| 2009/0169613 A1 | 7/2009 | Reznik et al. |
| 2010/0040587 A1 | 2/2010 | Haag et al. |
| 2010/0226927 A1 | 9/2010 | Weissman et al. |
| 2011/0104787 A1 | 5/2011 | Church et al. |
| 2011/0189211 A1 | 8/2011 | Gentry et al. |
| 2011/0262465 A1 | 10/2011 | Gao et al. |
| 2012/0264710 A1 | 10/2012 | Sandvold et al. |
| 2013/0109048 A1 | 5/2013 | Giugliano et al. |
| 2013/0252336 A1 | 9/2013 | Coleman et al. |
| 2013/0260459 A1 | 10/2013 | Coleman et al. |
| 2014/0068797 A1 | 3/2014 | Doudna et al. |
| 2014/0186958 A1 | 7/2014 | Zhang et al. |
| 2014/0273226 A1 | 9/2014 | Wu |
| 2014/0273230 A1 | 9/2014 | Chen et al. |
| 2014/0356956 A1 | 12/2014 | Church et al. |
| 2015/0071903 A1 | 3/2015 | Liu et al. |
| 2015/0165054 A1 | 6/2015 | Liu et al. |
| 2015/0166980 A1 | 6/2015 | Liu et al. |
| 2015/0166982 A1 | 6/2015 | Liu et al. |
| 2015/0166984 A1 | 6/2015 | Liu et al. |
| 2015/0166985 A1 | 6/2015 | Liu et al. |
| 2015/0224209 A1 | 8/2015 | Kohn et al. |
| 2016/0046961 A1 | 2/2016 | Jinek et al. |
| 2016/0200779 A1 | 7/2016 | Liu et al. |
| 2016/0201089 A1 | 7/2016 | Gersbach et al. |
| 2016/0208243 A1 | 7/2016 | Zhang et al. |
| 2016/0304846 A1 | 10/2016 | Liu et al. |
| 2016/0324982 A1 | 11/2016 | Scadden et al. |
| 2017/0066834 A1 | 3/2017 | Weissman et al. |
| 2017/0121693 A1 | 5/2017 | Liu et al. |
| 2017/0152528 A1 | 6/2017 | Zhang |
| 2017/0233703 A1 | 8/2017 | Xie et al. |
| 2017/0274100 A1 | 9/2017 | Adair et al. |
| 2017/0275648 A1 | 9/2017 | Barrangou et al. |
| 2017/0327804 A9 | 11/2017 | Joung et al. |
| 2017/0360954 A1 | 12/2017 | Nixon et al. |
| 2018/0073012 A1 | 3/2018 | Liu et al. |
| 2018/0127780 A1 | 5/2018 | Liu et al. |
| 2018/0179503 A1 | 6/2018 | Maianti et al. |
| 2018/0216095 A1 | 8/2018 | Thanos et al. |
| 2018/0223313 A1 | 8/2018 | Uchida et al. |
| 2018/0237768 A1 | 8/2018 | Reik et al. |
| 2018/0237787 A1 | 8/2018 | Maianti et al. |
| 2018/0289832 A1 | 10/2018 | Hartigan et al. |
| 2018/0312828 A1 | 11/2018 | Liu et al. |
| 2018/0327507 A1 | 11/2018 | Weissman et al. |
| 2019/0002875 A1 | 1/2019 | Cheng et al. |
| 2019/0010481 A1 | 1/2019 | Joung et al. |
| 2019/0093099 A1 | 3/2019 | Liu et al. |
| 2019/0100593 A1 | 4/2019 | Scadden et al. |
| 2019/0134217 A1 | 5/2019 | Nixon et al. |
| 2019/0144558 A1 | 5/2019 | Pearse et al. |
| 2019/0153114 A1 | 5/2019 | Pearse et al. |
| 2019/0169639 A1 | 6/2019 | Zhang et al. |
| 2019/0225955 A1 | 7/2019 | Liu et al. |
| 2019/0330373 A1 | 10/2019 | Stephan |
| 2019/0365806 A1 | 12/2019 | Jeker et al. |
| 2019/0367891 A1 | 12/2019 | Liu et al. |
| 2020/0041513 A1 | 2/2020 | Requirand et al. |
| 2020/0063127 A1 | 2/2020 | Lu et al. |
| 2020/0129557 A1 | 4/2020 | Shizuru et al. |
| 2020/0140818 A1 | 5/2020 | Pompilio et al. |
| 2020/0188527 A1 | 6/2020 | Rossi et al. |
| 2020/0190493 A1 | 6/2020 | Liu et al. |
| 2020/0255523 A1 | 8/2020 | Palchaudhuri et al. |
| 2020/0308571 A1 | 10/2020 | Joung et al. |
| 2020/0340985 A1 | 10/2020 | Mikolajczyk et al. |
| 2020/0376135 A1 | 12/2020 | Boitano et al. |
| 2020/0399626 A1 | 12/2020 | Liu et al. |
| 2020/0407440 A1 | 12/2020 | McDonagh et al. |
| 2021/0015917 A1 | 1/2021 | Heiss et al. |
| 2021/0032596 A1 | 2/2021 | Heidaran et al. |
| 2021/0079344 A1 | 3/2021 | Bosio et al. |
| 2021/0093667 A1 | 4/2021 | Zhang et al. |
| 2021/0130805 A1 | 5/2021 | Gaudelli et al. |
| 2021/0130850 A1 | 5/2021 | Joung et al. |
| 2021/0137991 A1 | 5/2021 | Rabinowitz |
| 2021/0162063 A1 | 6/2021 | Nixon et al. |
| 2021/0171654 A1 | 6/2021 | Liu et al. |
| 2021/0198330 A1 | 7/2021 | Liu et al. |
| 2021/0206872 A1 | 7/2021 | Pearse et al. |
| 2021/0252118 A1 | 8/2021 | Slaymaker et al. |
| 2021/0283267 A1 | 9/2021 | Boitano et al. |
| 2021/0317228 A1 | 10/2021 | Pearse et al. |
| 2021/0317440 A1 | 10/2021 | Liu et al. |
| 2021/0371858 A1 | 12/2021 | Evans et al. |
| 2021/0379195 A1 | 12/2021 | Palchaudhuri et al. |
| 2021/0380955 A1 | 12/2021 | Bryson et al. |
| 2021/0388094 A1 | 12/2021 | Scadden et al. |
| 2021/0388396 A1 | 12/2021 | Chen et al. |
| 2022/0023348 A1 | 1/2022 | Gibbs et al. |
| 2022/0047637 A1 | 2/2022 | Lamothe-Dreuzy et al. |
| 2022/0111079 A1 | 4/2022 | Hoge et al. |
| 2022/0119785 A1 | 4/2022 | Liu et al. |
| 2022/0127594 A1 | 4/2022 | Gaudelli et al. |
| 2022/0136012 A1 | 5/2022 | Gaudelli et al. |
| 2022/0169998 A1 | 6/2022 | Joung et al. |
| 2022/0170027 A1 | 6/2022 | Gaudelli et al. |
| 2022/0220462 A1 | 7/2022 | Liu et al. |
| 2022/0235347 A1 | 7/2022 | Slaymaker et al. |
| 2022/0290115 A1 | 9/2022 | Liu et al. |
| 2022/0290134 A1 | 9/2022 | Jin et al. |
| 2022/0370575 A1 | 11/2022 | Slaymaker et al. |
| 2022/0380757 A1 | 12/2022 | Bauer et al. |
| 2022/0387622 A1 | 12/2022 | Gehrke et al. |
| 2022/0401530 A1 | 12/2022 | Bryson et al. |
| 2023/0017979 A1 | 1/2023 | Hartigan et al. |
| 2023/0021641 A1 | 1/2023 | Liu et al. |
| 2023/0075877 A1 | 3/2023 | Gaudelli et al. |
| 2023/0101597 A1 | 3/2023 | Gaudelli et al. |

(56) References Cited

U.S. PATENT DOCUMENTS

| | | | |
|---|---|---|---|
| 2023/0108687 A1 | 4/2023 | Liu et al. |
| 2023/0128472 A1 | 4/2023 | Slaymaker et al. |
| 2023/0140953 A1 | 5/2023 | Slaymaker et al. |
| 2023/0159956 A1 | 5/2023 | Bryson et al. |
| 2023/0193242 A1 | 6/2023 | Zhang et al. |
| 2023/0212575 A1 | 7/2023 | Odate et al. |
| 2023/0242884 A1 | 8/2023 | Smith et al. |
| 2023/0348883 A1 | 11/2023 | Liu et al. |
| 2023/0383277 A1 | 11/2023 | Cafferty et al. |

FOREIGN PATENT DOCUMENTS

| | | | |
|---|---|---|---|
| CN | 105934516 A | 9/2016 |
| CN | 106061510 A | 10/2016 |
| CN | 106916852 A | 7/2017 |
| CN | 107043779 A | 8/2017 |
| CN | 107109413 A | 8/2017 |
| CN | 107532161 A | 1/2018 |
| CN | 108064282 A | 5/2018 |
| CN | 108513575 A | 9/2018 |
| CN | 109295186 A | 2/2019 |
| CN | 109328231 A | 2/2019 |
| CN | 109957569 A | 7/2019 |
| CN | 110042124 A | 7/2019 |
| CN | 110214180 A | 9/2019 |
| EP | 2574665 A1 | 4/2013 |
| EP | 2707028 B1 | 3/2017 |
| EP | 2877490 B1 | 9/2018 |
| EP | 3700568 A2 | 9/2020 |
| EP | 3877415 A1 | 9/2021 |
| EP | 3886869 A1 | 10/2021 |
| EP | 3956349 A1 | 2/2022 |
| EP | 3958879 A1 | 3/2022 |
| JP | 2015529466 A | 10/2015 |
| JP | 2016528890 A | 9/2016 |
| JP | 2017500035 A | 1/2017 |
| JP | 6629734 A2 | 1/2020 |
| KR | 20160050069 A | 5/2016 |
| NO | 2019084053 A1 | 5/2019 |
| NO | 2021041945 A2 | 3/2021 |
| WO | 1992021766 A1 | 12/1992 |
| WO | 1994008039 A1 | 4/1994 |
| WO | 1996031538 A1 | 10/1996 |
| WO | 2000007021 A1 | 2/2000 |
| WO | 2001038547 A2 | 5/2001 |
| WO | 2002068676 A2 | 9/2002 |
| WO | 2002103028 A2 | 12/2002 |
| WO | 2003016867 A2 | 2/2003 |
| WO | 2003026584 A2 | 4/2003 |
| WO | 2003042405 A2 | 5/2003 |
| WO | 2003065881 A2 | 8/2003 |
| WO | 2004002425 A2 | 1/2004 |
| WO | 2004005531 A2 | 1/2004 |
| WO | 2005027972 A2 | 3/2005 |
| WO | 2005042703 A2 | 5/2005 |
| WO | 2006062946 A2 | 6/2006 |
| WO | 2006074308 A2 | 7/2006 |
| WO | 2007011088 A1 | 1/2007 |
| WO | 2007048067 A2 | 4/2007 |
| WO | 2007052849 A1 | 5/2007 |
| WO | 2007084949 A2 | 7/2007 |
| WO | 2007127317 A2 | 11/2007 |
| WO | 2008067115 A2 | 6/2008 |
| WO | 2008076143 A1 | 6/2008 |
| WO | 2008085951 A2 | 7/2008 |
| WO | 2008115300 A1 | 9/2008 |
| WO | 2009058983 A2 | 5/2009 |
| WO | 2010136508 A2 | 12/2010 |
| WO | 2010140885 A1 | 12/2010 |
| WO | 2011073521 A1 | 6/2011 |
| WO | 2011075627 A1 | 6/2011 |
| WO | 2012047951 A2 | 4/2012 |
| WO | 2012154480 A1 | 11/2012 |
| WO | 2012154962 A2 | 11/2012 |
| WO | 2012171112 A1 | 12/2012 |
| WO | 2013010406 A1 | 1/2013 |
| WO | 2013126794 A1 | 8/2013 |
| WO | 2013165061 A1 | 11/2013 |
| WO | 2013166281 A1 | 11/2013 |
| WO | 2013176772 A1 | 11/2013 |
| WO | 2013188037 A2 | 12/2013 |
| WO | 2014036219 A2 | 3/2014 |
| WO | 2014062978 A1 | 4/2014 |
| WO | 2014066271 A1 | 5/2014 |
| WO | 2014066545 A1 | 5/2014 |
| WO | 2014081712 A2 | 5/2014 |
| WO | 2014089290 A1 | 6/2014 |
| WO | 2014186686 A2 | 11/2014 |
| WO | 2014197748 A2 | 12/2014 |
| WO | 2014197821 A1 | 12/2014 |
| WO | 2015004400 A1 | 1/2015 |
| WO | 2015006498 A2 | 1/2015 |
| WO | 2015021426 A1 | 2/2015 |
| WO | 2015089277 A1 | 6/2015 |
| WO | 2015089406 A1 | 6/2015 |
| WO | 2015089486 A2 | 6/2015 |
| WO | 2015148512 A1 | 10/2015 |
| WO | 2015153805 A2 | 10/2015 |
| WO | 2015191693 A2 | 12/2015 |
| WO | 2016038011 A1 | 3/2016 |
| WO | 2016049258 A2 | 3/2016 |
| WO | 2016069910 A1 | 5/2016 |
| WO | 2016072399 A1 | 5/2016 |
| WO | 2014043442 A9 | 6/2016 |
| WO | 2016094872 A1 | 6/2016 |
| WO | 2016135558 A2 | 9/2016 |
| WO | 2016135559 A2 | 9/2016 |
| WO | 2016149682 A2 | 9/2016 |
| WO | 2016164502 A1 | 10/2016 |
| WO | 2016183236 A1 | 11/2016 |
| WO | 2016205711 A1 | 12/2016 |
| WO | 2016205759 A1 | 12/2016 |
| WO | 2017011721 A1 | 1/2017 |
| WO | 2017048969 A1 | 3/2017 |
| WO | 2017070632 A2 | 4/2017 |
| WO | 2017070633 A2 | 4/2017 |
| WO | 2017077386 A1 | 5/2017 |
| WO | 2017077394 A2 | 5/2017 |
| WO | 2017093804 A2 | 6/2017 |
| WO | 2017160890 A1 | 9/2017 |
| WO | 2017165862 A1 | 9/2017 |
| WO | 2017173054 A1 | 10/2017 |
| WO | 2017179718 A1 | 10/2017 |
| WO | 2017181110 A1 | 10/2017 |
| WO | 2017184768 A1 | 10/2017 |
| WO | 2017189308 A1 | 11/2017 |
| WO | 2017191503 A1 | 11/2017 |
| WO | 2017205843 A1 | 11/2017 |
| WO | 2017219029 A2 | 12/2017 |
| WO | 2018020323 A2 | 2/2018 |
| WO | 2018027036 A1 | 2/2018 |
| WO | 2018027078 A1 | 2/2018 |
| WO | 2018035388 A1 | 2/2018 |
| WO | 2018039438 A1 | 3/2018 |
| WO | 2018039810 A1 | 3/2018 |
| WO | 2018041973 A1 | 3/2018 |
| WO | 2018048815 A1 | 3/2018 |
| WO | 2018071868 A1 | 4/2018 |
| WO | 2018085516 A2 | 5/2018 |
| WO | 2018089664 A1 | 5/2018 |
| WO | 2018119354 A1 | 6/2018 |
| WO | 2018119359 A1 | 6/2018 |
| WO | 2018129129 A1 | 7/2018 |
| WO | 2018140940 A1 | 8/2018 |
| WO | 2018142364 A1 | 8/2018 |
| WO | 2018160768 A1 | 9/2018 |
| WO | 2018165629 A1 | 9/2018 |
| WO | 2018170184 A1 | 9/2018 |
| WO | 2018176009 A1 | 9/2018 |
| WO | 2018183613 A1 | 10/2018 |
| WO | 2018191746 A1 | 10/2018 |
| WO | 2018213708 A1 | 11/2018 |
| WO | 2018213726 A1 | 11/2018 |
| WO | 2018218188 A2 | 11/2018 |

(56) References Cited

FOREIGN PATENT DOCUMENTS

| | | |
|---|---|---|
| WO | 2019003193 A1 | 1/2019 |
| WO | 2019005884 A1 | 1/2019 |
| WO | 2019005886 A1 | 1/2019 |
| WO | 2019018383 A1 | 1/2019 |
| WO | 2019023680 A1 | 1/2019 |
| WO | 2019040650 A1 | 2/2019 |
| WO | 2019071274 A1 | 4/2019 |
| WO | 2019077496 A1 | 4/2019 |
| WO | 2019079347 A1 | 4/2019 |
| WO | 2019081982 A1 | 5/2019 |
| WO | 2019082124 A1 | 5/2019 |
| WO | 2019084057 A2 | 5/2019 |
| WO | 2019084064 A2 | 5/2019 |
| WO | 2019087047 A1 | 5/2019 |
| WO | 2019111185 A1 | 6/2019 |
| WO | 2019113437 A1 | 6/2019 |
| WO | 2019118516 A1 | 6/2019 |
| WO | 2019120310 A1 | 6/2019 |
| WO | 2019126709 A1 | 6/2019 |
| WO | 2019139645 A2 | 7/2019 |
| WO | 2019155067 A1 | 8/2019 |
| WO | 2019173654 A2 | 9/2019 |
| WO | 2019178151 A1 | 9/2019 |
| WO | 2019178280 A1 | 9/2019 |
| WO | 2019178416 A1 | 9/2019 |
| WO | 2019178426 A1 | 9/2019 |
| WO | 2019183000 A1 | 9/2019 |
| WO | 2019204378 A1 | 10/2019 |
| WO | 2019217941 A1 | 11/2019 |
| WO | 2019217942 A1 | 11/2019 |
| WO | 2019217943 A1 | 11/2019 |
| WO | 2019217944 A1 | 11/2019 |
| WO | 2019222212 A1 | 11/2019 |
| WO | 2019234694 A2 | 12/2019 |
| WO | 2020028823 A1 | 2/2020 |
| WO | 2020047326 A2 | 3/2020 |
| WO | 2020051561 A1 | 3/2020 |
| WO | 2020065303 A1 | 4/2020 |
| WO | 2020072534 A1 | 4/2020 |
| WO | 2020076105 A1 | 4/2020 |
| WO | 2020086776 A1 | 4/2020 |
| WO | 2020092655 A1 | 5/2020 |
| WO | 2020112687 A2 | 6/2020 |
| WO | 2020112870 A1 | 6/2020 |
| WO | 2020124008 A1 | 6/2020 |
| WO | 2020160514 A1 | 8/2020 |
| WO | 2020160517 A1 | 8/2020 |
| WO | 2020163396 A1 | 8/2020 |
| WO | 2020168051 A1 | 8/2020 |
| WO | 2020168075 A1 | 8/2020 |
| WO | 2020168088 A1 | 8/2020 |
| WO | 2020168122 A1 | 8/2020 |
| WO | 2020168132 A1 | 8/2020 |
| WO | 2020168133 A1 | 8/2020 |
| WO | 2020168135 A1 | 8/2020 |
| WO | 2020216947 A1 | 10/2020 |
| WO | 2020219748 A2 | 10/2020 |
| WO | 2020219770 A1 | 10/2020 |
| WO | 2020219774 A1 | 10/2020 |
| WO | 2020219775 A1 | 10/2020 |
| WO | 2020219778 A2 | 10/2020 |
| WO | 2020219861 A1 | 10/2020 |
| WO | 2020219964 A1 | 10/2020 |
| WO | 2020236936 A1 | 11/2020 |
| WO | 2020242895 A1 | 12/2020 |
| WO | 2020248064 A1 | 12/2020 |
| WO | 2021020884 A2 | 2/2021 |
| WO | 2021022044 A1 | 2/2021 |
| WO | 2021041945 A2 | 3/2021 |
| WO | 2021044008 A1 | 3/2021 |
| WO | 2021050571 A1 | 3/2021 |
| WO | 2021052402 A1 | 3/2021 |
| WO | 2021055408 A1 | 3/2021 |
| WO | 2021079273 A1 | 4/2021 |
| WO | 2021091377 A1 | 5/2021 |
| WO | 2021097329 A1 | 5/2021 |
| WO | 2021099418 A1 | 5/2021 |
| WO | 2021107566 A1 | 6/2021 |
| WO | 2021123397 A1 | 6/2021 |
| WO | 2021158921 A2 | 8/2021 |
| WO | 2021163587 A1 | 8/2021 |
| WO | 2021175288 A1 | 9/2021 |
| WO | 2021175914 A1 | 9/2021 |
| WO | 2021188590 A2 | 9/2021 |
| WO | 2021207651 A2 | 10/2021 |
| WO | 2021211734 A1 | 10/2021 |
| WO | 2021228944 A1 | 11/2021 |
| WO | 2021239308 A1 | 12/2021 |
| WO | 2021249228 A1 | 12/2021 |
| WO | 2022008935 A1 | 1/2022 |
| WO | 2022011458 A1 | 1/2022 |
| WO | 2022015969 A1 | 1/2022 |
| WO | 2022036179 A2 | 2/2022 |
| WO | 2022040596 A1 | 2/2022 |
| WO | 2022043538 A1 | 3/2022 |
| WO | 2022056254 A2 | 3/2022 |
| WO | 2022056324 A1 | 3/2022 |
| WO | 2022081828 A1 | 4/2022 |
| WO | 2022081890 A1 | 4/2022 |
| WO | 2022112404 A1 | 6/2022 |
| WO | 2022143694 A1 | 7/2022 |
| WO | 2022150706 A2 | 7/2022 |
| WO | 2022155458 A1 | 7/2022 |
| WO | 2023279118 A2 | 1/2023 |
| WO | 2023034959 A2 | 3/2023 |
| WO | 2023047338 A1 | 3/2023 |
| WO | 2023049299 A2 | 3/2023 |
| WO | 2023125814 A1 | 7/2023 |
| WO | 2023155901 A1 | 8/2023 |
| WO | 2023247753 A1 | 12/2023 |
| WO | 2023248110 A1 | 12/2023 |

OTHER PUBLICATIONS

UniProt Accession No. Q99ZW2, Create Date Jul. 11, 2012.
UniProt Accession No. P01011, Create Date Jul. 21, 1986.
UniProt Proteome ID No. UP000009215, Create Date May 2012.
MVik et al., "Endonuclease V cleaves at inosines in RNA," Nature Communications, 2013, vol. 4, No. 2271, pp. 1-7.
Wacey et al., "Disentangling the perturbational effects of amino acid substitutions in the DNA-binding domain of p53," Human Genetics, 1999, vol. 104, pp. 15-22.
Walton et al., "Unconstrained genome targeting with near-PAMless engineered CRISPR-Cas9 variants," Science, Mar. 26, 2020, pp. 1-11.
Wang et al., "Enhanced base editing by co-expression of free uracil DNA glycosylase inhibitor," Cell research, Oct. 2017, vol. 27, No. 10, pp. 1289-1292.
Wang et al., "Eliminating base-editor-induced genome-wide and transcriptome-wide off-target mutations," Nature Cell Biology, 2021, pp. 1-32.
Wienert et al., "KLF1 drives the expression of fetal hemoglobin in British HPFH," Blood, Aug. 10, 2017, vol. 130, No. 6, pp. 803-807.
Wijesinghe et al., "Efficient deamination of 5-methylcytosines in DNA by human APOBEC3A, but not by AID or APOBEC3G," Nucleic Acids Research, Jul. 13, 2012, vol. 40, No. 18, pp. 9206-9217.
Wolf et al., "TadA, an Essential TRNA-Specific Adenosine Deaminase from *Escherichia coli*," The EMBO Journal, Jul. 15, 2002, vol. 21, No. 14, pp. 3841-3851.
Yan et al., "Functionally diverse type V CRISPR-Cas systems," Science, Jan. 4, 2019, vol. 363, pp. 88-91.
Yang et al., "Increasing targeting scope of adenosine base editors in mouse and rat embryos through fusion of TadA deaminase with Cas9 variants," Protein Cell, 2018, vol. 9, No. 9, pp. 814-819.
Yang et al., "PAM-Dependent Target DNA Recognition and Cleavage by C2c1 CRISPR-Cas Endonuclease," Cell, Dec. 15, 2016, vol. 167, pp. 1814-1828.
Yang et al., "Engineering and Optimising Deaminase Fusions for Genome Editing," Nature Communications, Nov. 2, 2016, vol. 7, No. 13330, pp. 1-11.

(56) References Cited

OTHER PUBLICATIONS

Yasui et al., "Miscoding Properties of 2'-Deoxyinosine, a Nitric Oxide-Derived DNA Adduct, during Translesion Synthesis Catalyzed by Human DNA Polymerases," Journal of Molecular Biology, 2008, vol. 377, pp. 1015-1023.
Yeh et al., "In vivo base editing of post-mitotic sensory cells," Nature Communications, 2018, vol. 9, No. 2184, pp. 1-10.
Yu et al., "Cytosine base editors with minimized unguided DNA and RNA off-target events and high on-target activity," Nature Communications, 2020, vol. 11, No. 2052, pp. 1-10.
Zafra et al., "Optimized base editors enable efficient editing in cells, organoids and mice," Nature Biotechnology, 2018, pp. 1-6.
Zhang et al., "Programmable base editing of zebrafish genome using a modified CRISPR-Cas9 system," Nature Communications, 2017, vol. 8, No. 118, pp. 1-5.
Zheng et al., "DNA Editing in DNA/RNA Hybrids by Adenosine Deaminases That Act on RNA," Nucleic Acids Research, 2017, vol. 45, No. 6, pp. 3369-3377.
Zhou et al., "Atypical behaviour and connectivity in SHANK3-mutant macaques," Nature, Jun. 20, 2019, vol. 570, pp. 326-331.
Zhou et al., "Off-target RNA mutation induced by DNA base editing and its elimination by mutagenesis," Nature, Jul. 11, 2019, vol. 571, pp. 275-278.
Zong et al., "Precise base editing in rice, wheat and maize with a Cas9-cytidine deaminase fusion," Nature Biotechnology, 2017, pp. 1-4.
Zuo et al., "Cytosine base editor generates substantial off-target single-nucleotide variants in mouse embryos," Science, Aug. 19, 2019, vol. 364, No. 6437, pp. 289-292.
Zuris et al., "Efficient Delivery of Genome-Editing Proteins In Vitro and In Vivo," Nature Biotechnology, Jan. 2015, vol. 33, No. 1, pp. 73-80.
Written Opinion dated Jun. 17, 2020 in corresponding International Patent Application No. PCT/US2020/018192 (6 pages).
Written Opinion dated Jul. 20, 2020 in corresponding International Patent Application No. PCT/US2020/018193 (7 pages).
Written Opinion dated Feb. 9, 2021 in corresponding International Patent Application No. PCT/US20/48586 (15 bages).
Written Opinion dated Feb. 10, 2021 in corresponding International Patent Application No. PCT/US20/49975 (9 pages).
Written Opinion dated Jul. 6, 2021 in corresponding International Patent Application No. PCT/US2020/016288 (9 pages).
Extended European Search Report dated Feb. 2, 2022 in corresponding European Patent Application No. 19799482.5 (9 pages).
Adachi et al., "Effects of β6 amino acid hydrophobicity on stability and solubility of hemoglobin tetramers," FEBS Letters, Jan. 1993, vol. 315, No. 1, pp. 47-50.
Agliano et al., "Human acute leukemia cells injected in NOD/LtSz-scid/IL-2Rγ null mice generate a faster and more efficient disease compared to other NOD/scid-related strains," International Journal of Cancer, 2008, vol. 123, pp. 2222-2227.
Agrawal et al., "Hydroxyurea in Sickle Cell Disease: Drug Review," Indian Journal of Hematology and Blood Transfusion, Apr.-Jun. 2014, vol. 30, No. 2, pp. 91-96.
Ataga et al., "Crizanlizumab for the Prevention of Pain Crises in Sickle Cell Disease," The New England Journal of Medicine, Feb. 2, 2017, vol. 376, No. 5, pp. 429-439.
Baudin-Chich et al., "Enhanced Polymerization of Recombinant Human Deoxyhemoglobin β6 Glu->Ile," Proceedings of the National Academy of Sciences of the Untied States of America, Mar. 1990, vol. 87, pp. 1845-1849.
Bergman et al., "A New β-Chain Variant: Hb Stockholm [β 7(A4)Glu -->Asp] Causes Falsely Low Hb A1c," Hemoglobin, 2009, vol. 33, No. 2, pp. 137-142.
Bernaudin et al., "Long-term results of related myeloablative stem-cell transplantation to cure sickle cell disease," Blood, Oct. 1, 2007, vol. 110, No. 7, pp. 2749-2756.
Biasco et al., "In Vivo Tracking of Human Hematopoiesis Reveals Patterns of Clonal Dynamics during Early and Steady-State Reconstitution Phases," Cell Stem Cell, Jul. 7, 2016, vol. 19, pp. 107-119.

Bihoreau et al., "Steric and hydrophobic determinants of the solubilities of recombinant sickle cell hemoglobins," Protein Science, 1992, vol. 1, pp. 145-150.
Bird et al., "Expansion of Human and Murine Hematopoietic Stem and Progenitor Cells Ex Vivo without Genetic Modification Using MYC and Bcl-2 Fusion Proteins," PLoS One, Aug. 2014, vol. 9, No. 8, e105525, pp. 1-20.
Blackwell et al., "Haemoglobin Siriraj, β-7 (βA4) Glu-->Lys, in a Chinese Subject in Taiwan," Vox Sanguinis, 1972, vol. 23, pp. 433-438.
Blackwell et al., "Hemoglobin G Makassar: β-6 Glu-->Ala," Biochimica et Biophysica Acta, 1970, vol. 214, pp. 396-401.
Borsotti et al., "HSC extrinsic sex-related and intrinsic autoimmune disease-related human B-cell variation is recapitulated in humanized mice," Blood Advances, Oct. 24, 2017, vol. 1, No. 23, pp. 2007-2018.
Boulad et al., "Safety and efficacy of plerixafor dose escalation for the mobilization of CD34+ hematopoietic progenitor cells in patients with sickle cell disease: interim results," Haematologica, 2018, vol. 103, No. 5, pp. 770-777.
Bradford et al., "Quiescence, cycling, and turnover in the primitive hematopoietic stem cell compartment," Experimental Hematology, 1997, vol. 25, pp. 445-453.
Burroughs et al., "Allogeneic Hematopoietic Cell Transplantation Using Treosulfan-Based Conditioning for Treatment of Marrow Failure Disorders," Biology of Blood and Marrow Transplantation, 2017, vol. 23, pp. 1669-1677.
Burstein et al., "New CRISPR-Cas systems from uncultivated microbes," Howard Hughes Medical Institute, Feb. 9, 2017, vol. 542, Article No. 7640, pp. 237-241.
Canver et al., "Integrated design, execution, and analysis of arrayed and pooled CRISPR genome-editing experiments," Nature Protocols, 2018, vol. 13, No. 5, pp. 946-986.
Chang et al., "Comparative Studies Reveal Robust HbF Induction By Editing of HBG1/2 Promoters or BCL11A Erythroid-Enhancer in Human CD34+ Cells but That BCL11A Erythroid-Enhancer Editing Is Associated with Selective Reduction in Erythroid Lineage Reconstitution in a Xenotransplantation Model," Blood, Nov. 29, 2018, vol. 132, Article No. Suppl. 1, p. 409.
Chang et al., "Long-Term Engraftment and Fetal Globin Induction upon BCL11A Gene Editing in Bone-Marrow-Derived CD34+ Hematopoietic Stem and Progenitor Cells," Molecular Therapy: Methods & Clinical Development, Mar. 2017, vol. 4, pp. 137-148.
Chang et al., "Saturated Mutagenesis Surrounding Beta-globin Locus Identifies Novel Therapeutic Targets for Fetal Globin Induction and Treatment of Sickle Cell Anemia," Editas Medicine, PowerPoint Presentation, 2018, p. 196.
Chaudhari et al., "Evaluation of Homology-Independent CRISPR-Cas9 Off-Target Assessment Methods," The CRISPR Journal, 2020, vol. 3, No. 6, pp. 440-453.
Cheng et al., "Cloning, expression and activity identification of human innate immune protein apolipoprotein B mRNA editing enzyme catalytic subunit 3A(APOBEC3A)," Chinese Journal of Cellular and Molecular Immunology, 2017, vol. 33, No. 2, pp. 179-184 [English Abstract].
Cheng et al., "Plerixafor is effective given either preemptively or as a rescue strategy in poor stem cell mobilizing patients with multiple myeloma," Transfusion, Feb. 2015, vol. 55, pp. 275-283.
Chhabra et al., "Hematopoietic stem cell transplantation in immunocompetent hosts without radiation or chemotherapy," Science Translational Medicine, Aug. 10, 2016, vol. 8, No. 351, 351ra105, pp. 1-28.
Choi et al., "No evidence for cell activation or brain vaso-occlusion with plerixafor mobilization in sickle cell mice," Blood Cells, Molecules, and Diseases, Mar. 2016, vol. 57, pp. 67-70.
Corrado et al., "SOD1 gene mutations in Italian patients with Sporadic Amyotrophic Lateral Sclerosis (ALS)," Neuromuscular Disorders, 2006, vol. 16, pp. 800-804.
Cyranoski, David, "Blood stem cells produced in vast quantities in the lab," Nature, Jun. 6, 2019, vol. 570, pp. 17-18.
Czechowicz et al., "Selective hematopoietic stem cell ablation using CD117-antibody-drug-conjugates enables safe and effective trans-

(56) References Cited

OTHER PUBLICATIONS plantation with immunity preservation," Nature Communications, 2019, vol. 10, No. 617, pp. 1-21.
Devi et al., "Neutrophil mobilization via plerixafor-mediated CXCR4 inhibition arises from lung demargination and blockade of neutrophil homing to the bone marrow," The Journal of Experimental Medicine, 2013, vol. 210, No. 11, pp. 2321-2336.
Doulatov et al., "Revised map of the human progenitor hierarchy shows the origin of macrophages and dendritic cells in early lymphoid development," Nature Immunology, Jul. 2010, vol. 11, No. 7, pp. 585-593.
Du et al., "Biomarker signatures of sickle cell disease severity," Blood Cells, Molecules and Diseases, 2018, vol. 72, pp. 1-9.
Eaton et al., "Treating sickle cell disease by targeting HbS polymerization," Blood, May 18, 2017, vol. 129, No. 20, pp. 2719-2726.
Edison et al., "A novel β-globin gene mutation HBB.c.22 G>C produces a hemoglobin variant (Hb Vellore) mimicking HbS in HPLC," International Journal of Laboratory Hematology, 2012, vol. 34, pp. 556-558.
Ekstrand et al., "Frequent alterations of the PI3K/AKT/mTOR pathways in hereditary nonpolyposis colorectal cancer," Familial Cancer, 2010, vol. 9, pp. 125-129.
Ema et al., "Repopulation dynamics of single haematopoietic stem cells in mouse transplantation experiments: Importance of stem cell composition in competitor cells," Journal of Theoretical Biology, 2016, vol. 394, pp. 57-67.
ENA Accession No. BDB43378, downloaded Apr. 24, 2023.
Esrick et al., "Successful hematopoietic stem cell mobilization and apheresis collection using plerixafor alone in sickle cell patients," Blood Advances, Oct. 9, 2018, vol. 2, No. 19, pp. 2505-2512.
FDA, "FDA approves crizanlizumab-tmca for sickle cell disease," Food and Drug Administration (FDA), Nov. 15, 2019, <https://www.fda.gov/drugs/resources-information-approved-drugs/fda-approves-crizanlizumab-tmca-sickle-cell-disease>.
Fiorini et al., "Developmentally-faithful and effective human erythropoiesis in immunodeficient and Kit mutant mice," American Journal of Hematology, 2017, vol. 92, pp. E513-E519.
Fitzhugh et al., "Granulocyte Colony-Stimulating Factor (G-CSF) Administration in Individuals with Sickle Cell Disease: Time for a Moratorium?" Cytotherapy, 2009, vol. 11, Article No. 4, pp. 464-471.
Giralt et al., "Optimizing Autologous Stem Cell Mobilization Strategies to Improve Patient Outcomes: Consensus Guidelines and Recommendations," Biology of Blood and Marrow Transplantation, 2014, vol. 20, pp. 295-308.
Gluckman et al., "Sickle cell disease: an international survey of results of HLA-identical sibling hematopoietic stem cell transplantation," Blood, Mar. 16, 2017, vol. 129, No. 11, pp. 1548-1556.
Goldstein et al., "In Situ Modification of Tissue Stem and Progenitor Cell Genomes," Cell Reports, Apr. 23, 2019, vol. 27, pp. 1254-1264.
Grevet et at, "Domain-focused CRISPR screen identifies HRI as a fetal hemoglobin regulator in human erythroid cells," Science, Jul. 20, 2018, vol. 361, pp. 285-290.
Guiu et al., "Tracing the origin of adult intestinal stem cells," Nature, Jun. 6, 2019, vol. 570, pp. 107-111.
Haubner et al., "Coexpression profile of leukemic stem cell markers for combinatorial targeted therapy in AML," Leukemia, 2019, vol. 33, pp. 64-74.
Hawksworth et al., "Enhancement of red blood cell transfusion compatibility using CRISPR-mediated erythroblast gene editing," EMBO Molecular Medicine, 2018, vol. 10, No. e8454, pp. 1-11.
Hirose et al., "Immortalization of Erythroblasts by c-MYC and BCL-XL Enables Large-Scale Erythrocyte Production from Human Pluripotent Stem Cells," Stem Cell Reports, Dec. 17, 2013, vol. 1, pp. 499-508.
Hoban et al., "Genetic treatment of a molecular disorder: gene therapy approaches to sickle cell disease," Blood, Feb. 18, 2016, vol. 127, No. 7, pp. 839-848.

Hill et al., "Functional Analysis of Conserved Histidines in ADP-Glucose Pyrophosphorylase from *Escherichia coli*," Biochemical Biophysical Research Communications, 1998, vol. 244, No. 2, pp. 573-577.
Houdebine, Louis-Marie, "The methods to generate transgenic animals and to control transgene expression," Journal of Biotechnology, 2002, vol. 98, pp. 145-160.
Hu et al., "Evolved Cas9 variants with broad PAM compatibility and high DNA specificity," Nature, Apr. 5, 2018, vol. 556, pp. 57-63.
Hua et al., "Expanding the base editing scope in rice by using Cas9 variants," Plant Biotechnology Journal, 2019, vol. 17, pp. 499-504.
Huang et al., "Circularly permuted and PAM-modified Cas9 variants broaden the targeting scope of base editors," Nature Biotechnology, Jun. 2019, vol. 37, No. 6, pp. 626-631.
Huang et al., "DNA epigenome editing using CRISPR-Cas SunTag-directed DNMT3A," Genome Biology, 2017, vol. 18, No. 176, pp. 1-11.
Jeong et al., "Adenine base editor engineering reduces editing of bystander cytosines," Nature Biotechnology, 2021, pp. 1-12.
Jeong et al., "Precise adenine base editors that exhibit minimized cytosine catalysis," Research Square, 2020, pp. 1-15.
Jiang et al., "Chemical modifications of adenine base editor mRNA and guide RNA expand its application scope," Nature Communications, 2020, vol. 11, No. 1979, pp. 1-9.
Jin et al., "Cytosine, but not adenine, base editors induce genome-wide off-target mutations in rice," Science, 2019, vol. 364, No. 6437, pp. 292-295.
Jinek et al., "A Programmable Dual-RNA-Guided DNA Endonuclease in Adaptive Bacterial Immunity," Science, Aug. 17, 2012, vol. 337, No. 6096, pp. 816-821.
Jinek et al., "RNA-programmed genome editing in human cells," eLife, 2013, vol. 2, No. e00471, pp. 1-9.
Jore et al., "Structural basis for CRISPR RNA-guided DNA recognition by Cascade," Nature Structural & Molecular Biology, May 2011, vol. 18, No. 5, pp. 529-537.
Kappel et al., "Regulating gene expression in transgenic animals," Current Opinion in Biotechnology, 1992, vol. 3, pp. 548-553.
Kim et al., "Adenine base editors catalyze cytosine conversions in human cells," Nature Biotechnology, Oct. 2019, vol. 37, pp. 1145-1148.
Kim et al., "Highly efficient RNA-guided base editing in mouse embryos," Nature Biotechnology, 2017, pp. 1-4.
Kim et al., "Increasing the genome-targeting scope and precision of base editing with engineered Cas9-cytidine deaminase fusions," Nature Biotechnology, 2017, pp. 1-7.
Kim et al., "Rescue of high-specificity Cas9 variants using sgRNAs with matched 5' nucleotides," Genome Biology, 2017, vol. 18, No. 218, pp. 1-6.
Kim et al., "Transcriptional Repression by Zinc Finger Peptides," The Journal of Biological Chemistry, Nov. 21, 1997, vol. 272, No. 47, pp. 29795-29800.
Kim et al., "Structural and Kinetic Characterization of *Escherichia coli* TadA, the Wobble-Specific TRNA Deaminase," Biochemistry, 2006, vol. 45, No. 20, pp. 6407-6416.
Kitamura et al., "Uracil DNA Glycosylase Counteracts APOBEC3G-Induced Hypermutation of Hepatitis B Viral Genomes: Excision Repair of Covalently Closed Circular DNA," PLOS Pathogens, May 2013, vol. 9, No. 5, e1003361, pp. 1-14.
Kleinstiver et al., "Broadening *Staphylococcus aureus* Cas9 Targeting Range by Modifying PAM Recognition," Nature Biotechnology, Dec. 2015, vol. 33, No. 12, pp. 1293-1298.
Kleinstiver et al., "Engineered CRISPR-Cas9 nucleases with altered PAM specificities," Nature, Jul. 23, 2015, vol. 523, pp. 481-485.
Kleinstiver et al., "High-fidelity CRISPR-Cas9 variants with undetectable genome-wide off-targets," Molecular Therapy, Jan. 28, 2016, vol. 529, No. 75187, pp. 490-495.
Koblan et al., "Improving cytidine and adenine base editors by expression optimization and ancestral reconstruction," Nature Biotechnology, 2018, pp. 1-4.
Komor et al., "Editing the Genome Without Double-Stranded DNA Breaks," ACS Chemical Biology, 2018, vol. 13, pp. 383-388.

(56) References Cited

OTHER PUBLICATIONS

Komor et al., "Improved base excision repair inhibition and bacteriophage Mu Gam protein yields C:G-to-T:A base editors with higher efficiency and product purity," Science Advances, Aug. 30, 2017, vol. 3, No. eaao4774, pp. 1-9.
Komor et al., "Programmable editing of a target base in genomic DNA without double-stranded DNA cleavage," Nature, May 19, 2016, vol. 533, pp. 420-424.
Krokan et al., "Uracil in DNA—occurrence, consequences and repair," Oncogene, 2002, vol. 21, pp. 8935-8948.
Kundu et al., "Leucine to proline substitution by SNP at position 197 in Caspase-9 gene expression leads to neuroblastoma: a bioinformatics analysis," 3 Biotech, 2013, vol. 3, pp. 225-234.
Kuscu et al., "CRISPR-Cas9-AID base editor is a powerful gain-of-function screening tool," Nature Methods, Dec. 2016, vol. 13 No. 12, pp. 983-984.
Kuscu et al., "CRISPR-STOP: gene silencing through base-editing-induced nonsense mutations," Nature Methods, 2017, pp. 1-5.
Kwart et al., "Precise and efficient scarless genome editing in stem cells using CORRECT," Nature Protocols, 2017, vol. 12, No. 2, pp. 329-354.
Lapinaite et al., "DNA capture by a CRISPR-Cas9-guided adenine base editor," Science, Jul. 31, 2020, vol. 369, No. 6503, pp. 566-571.
Lau et al., "Molecular Basis for Discriminating between Normal and Damaged Bases by the Human Alkyladenine Glycosylase, AAG," Proceedings of the National Academy of Sciences of the United States of America, Dec. 5, 2000, vol. 97, No. 25, pp. 13573-13578.
Lazar et al., "Transforming Growth Factor α: Mutation of Aspartic Acid 47 and Leucine 48 Results in Different Biological Activities," Molecular and Cellular Biology, Mar. 1988, vol. 8, No. 3, pp. 1247-1252.
Lee et al., "CRISPR-Pass: Gene Rescue of Nonsense Mutations Using Adenine Base Editors," Molecular Therapy, Aug. 2019, vol. 27, No. 8, pp. 1364-1371.
Lee et al., "Cytosine but not adenine base editor generates mutations in mice," bioRxiv, 2019, pp. 1-24.
Lee et al., "PIK3CA gene is frequently mutated in breast carcinomas and hepatocellular carcinomas," Oncogene, 2005, vol. 24, pp. 1477-1480.
Lenk et al., "Pathogenic Mechanism of the FIG4 Mutation Responsible for Charcot-Marie-Tooth Disease CMT4J," PLoS Genetics, Jun. 2011, vol. 7, No. 6, e1002104, pp. 1-13.
Lewis et al., "Cytosine deamination and the precipitous decline of spontaneous mutation during Earth's history," Proceedings of the National Academy of Sciences of the United States of America, Jul. 19, 2019, vol. 113, No. 29, pp. 8194-8199.
Li et al., "Current Approaches for Engineering Proteins with Diverse Biological Properties," Bio-Applications of Nanoparticles, 2007, pp. 1-16.
Li et al., "Highly efficient and precise base editing in discarded human tripronuclear embryos," Protein & Cell, 2017, vol. 8, No. 10, pp. 776-779.
Li et al., "Reactivation of γ-globin in adult β-YAC mice after ex vivo and in vivo hematopoietic stem cell genome editing," Blood, Jun. 28, 2018, vol. 131, No. 26, pp. 2915-2928.
Liang et al., "Correction of β-thalassemia mutant by base editor in human embryos," Protein & Cell, 2017, vol. 8, No. 11, pp. 811-822.
Liu et al., "C2c1-sgRNA Complex Structure Reveals RNA-Guided DNA Cleavage Mechanism," Molecular Cell, Jan. 19, 2017, vol. 65, pp. 310-322.
Losey et al., "Crystal structure of *Staphylococcus aureus* tRNA adenosine deaminase TadA in complex with RNA," Nature Structural & Molecular Biology, Feb. 2006, vol. 13, No. 2, pp. 153-159.
Lu et al., "Precise Editing of a Target Base in the Rice Genome Using a Modified CRISPR/Cas9 System," Molecular Plant, Mar. 2017, vol. 10, pp. 523-525.
Lyons et al., "Efficient Recognition of an Unpaired Lesion by a DNA Repair Glycosylase," Journal of the American Chemical Society, Dec. 16, 2009, vol. 131, No. 49, pp. 17742-17743.
Ma et al., "Targeted AID-mediated mutagenesis (TAM) enables efficient genomic diversification in mammalian cells," Nature Methods, Dec. 2016, vol. 13, No. 12, pp. 1029-1035.
Pule et al., "A Systematic Review of Known Mechanisms of Hydroxyurea-induced Foetal Haemoglobin for Treatment of Sickle Cell Disease," Expert Review of Hematology, Oct. 2015, vol. 8, Article No. 5, pp. 669-679.
Quintana et al., "Control of Treg and TH17 cell differentiation by the aryl hydrocarbon receptor," Nature, May 1, 2008, vol. 453, pp. 65-71.
Radtke et al., "A distinct hematopoietic stem cell population for rapid multilineage engraftment in nonhuman Primates," Science Translational Medicine, Nov. 1, 2017, vol. 9, No. eaan1145, pp. 1-10.
Rahmig et al., "Improved human erythropoiesis and platelet formation in humanized NSGW41 mice," Stem Cell Reports, Oct. 11, 2016, vol. 7, pp. 591-601.
Rees et al., "Sickle-cell disease," The Lancet, Dec. 11, 2010, vol. 376, pp. 2018-2031.
Rhoda et al., "Interaction of Hemoglobin Siriraj with Hemoglobin S: A Mild Sickle Cell Syndrome," Hemoglobin, 1986, vol. 10, No. 1, pp. 21-31.
Risueno et al., "Identification of T-lymphocytic leukemia-initiating stem cells residing in a small subset of patients with acute myeloid leukemic disease," Blood, Jun. 30, 2011, vol. 117, No. 26, pp. 7112-7120.
Rozenski et al., "The RNA Modification Database: 1999 update," Nucleic Acids Research, 1999, vol. 27, No. 1, pp. 196-197.
Russell et al., "Plerixafor and granulocyte colony-stimulating factor for first-line steady-state autologous peripheral blood stem cell mobilization in lymphoma and multiple myeloma: results of the prospective PREDICT trial," Haematologica, 2013, vol. 98, No. 2, pp. 172-178.
Saechan et al., "Molecular basis and hematological features of hemoglobin variants in Southern Thailand," International Journal of Hematology, 2010, vol. 92, pp. 445-450.
Sankaran et al., "Anemia: progress in molecular mechanisms and therapies," Nature Medicine, Mar. 2015, vol. 21. No. 3, pp. 221-230.
Saville et al., "Efficiencies of platform clinical trials: a vision for the future," Clinical Trials, 2016, vol. 13, No. 3, pp. 358-366.
Scala et al., "Dynamics of genetically engineered hematopoietic stem and progenitor cells after autologous transplantation in humans," Nature Medicine, 2018, vol. 24, Article No. 11, pp. 1683-1690.
Schroeder et al., "Mobilization of allogeneic peripheral blood stem cell donors with intravenous plerixafor mobilizes a unique graft," Blood, May 11, 2017, vol. 129, No. 19, pp. 2680-2692.
Stemcell Technologies, "Human Hematopoietic Stem and Progenitor Cell Phenotypes, Frequencies and Hierarchies," STEMCELL Technologies, 2016, Document No. 27034, Version 1.0.0, 1 page.
Strocchio et al., "Treosulfan-based conditioning regimen for allogeneic haematopoietic stem cell transplantation in children with sickle cell disease," British Journal of Haematology, 2015, vol. 169, pp. 726-736.
Sundd et al., "Pathophysiology of Sickle Cell Disease," Annual Review of Pathology: Mechanisms of Disease, 2019, vol. 14, pp. 263-292.
Tajer et al., "Ex Vivo Expansion of Hematopoietic Stem Cells for Therapeutic Purposes: Lessons from Development and the Niche," Cells, 2019, vol. 8, No. 169, pp. 1-15.
Trakarnsanga et al., "An immortalized adult human erythroid line facilitates sustainable and scalable generation of functional red cells," Nature Communications, 2017, vol. 8, Article No. 14750, pp. 1-7.
Trakarnsanga et al., "Induction of adult levels of β-globin in human erythroid cells that intrinsically express embryonic or fetal globin by transduction with KLF1 and BCL11A-XL," Haematologica, 2014, vol. 99, No. 11, pp. 1677-1685.
Treisman et al., "Specific transcription and RNA splicing defects in five cloned β-thalassaemia genes," Nature, Apr. 14, 1983, vol. 302, pp. 591-596.

(56) References Cited

OTHER PUBLICATIONS

Tsai et al., "CIRCLE-seq: a highly sensitive in vitro screen for genome-wide CRISPR-Cas9 nuclease off-targets," Nature Methods, Jun. 2017, vol. 14, Article No. 6, pp. 607-614.
Uchida et al., "High-Efficiency Lentiviral Transduction of Human CD34+ Cells in High-Density Culture with Poloxamer and Prostaglandin E2," Molecular Therapy: Methods & Clinical Development, Jun. 2019, vol. 13, pp. 187-196.
Uchida et al., "Serum-free Erythroid Differentiation for Efficient Genetic Modification and High-Level Adult Hemoglobin Production," Molecular Therapy: Methods & Clinical Development, Jun. 2018, vol. 9, pp. 247-256.
UniProt Accession No. A0A5F1IHX6, downloaded Apr. 11, 2023.
UniProt Accession No. A8AD26, downloaded Apr. 11, 2023.
Valdmanis et al., "A mutation that creates a pseudoexon in SOD1 causes familial ALS," Annals of Human Genetics, 2009, vol. 73, pp. 652-657.
Vichinsky et al., "A Phase 3 Randomized Trial of Voxelotor in Sickle Cell Disease," The New England Journal of Medicine, Aug. 8, 2019, vol. 381, No. 6, pp. 509-519.
Viprakasit et al., "Hb G-MAKASSAR [ββ(A3)Glu->Ala; CODON 6 (GAG->GCG)]: Molecular Characterization, Clinical, and Hematological Effects," Hemoglobin, 2002, vol. 26, No. 3, pp. 245-253.
Wang et al., "Hematopoietic Stem Cell Transplant into Non-Myeloablated W/Wv Mice to Detect Steady-State Engraftment Defects," Methods in Molecular Biology, 2008, vol. 430, pp. 171-181.
Weatherall, David J., "The Role of the Inherited Disorders of Hemoglobin, the First 'Molecular Diseases,' in the Future of Human Genetics," The Annual Review of Genomics and Human Genetics, 2013, vol. 14, pp. 1-24.
Wilburn et al., "The Prevalence and Role of Hemoglobin Variants in Biometric Screening of a Multiethnic Population: One Large Health System's Experience," American Journal of Clinical Pathology, 2017, vol. 147, pp. 589-595.
Wilkinson et al., "Long-term ex vivo haematopoietic-stem-cell expansion allows nonconditioned transplantation," Nature, Jul. 2019, vol. 571, Article No. 7763, pp. 117-121.
Wognum et al., "Mini-Review: Hematopoietic Stem and Progenitor Cells," STEMCELL Technologies, Apr. 2015, vol. 29068, No. 6.0.0, pp. 1-10.
Woodcock et al., "Master Protocols to Study Multiple Therapies, Multiple Diseases, or Both," The New England Journal of Medicine, Jul. 6, 2017, vol. 377, No. 1, pp. 62-70.
Yan et al., "High-efficiency and multiplex adenine base editing in plants using new TadA variants," Molecular Plant, May 3, 2021, vol. 14, pp. 722-731.
Yang et al., "Engineering and optimising deaminase fusions for genome editing," Nature Communications, 2016, vol. 7, Article No. 13330, pp. 1-11.
Yannaki et al., "Hematopoietic Stem Cell Mobilization for Gene Therapy of Adult Patients with Severe β-Thalassemia: Results of Clinical Trials Using G-CSF or Plerixafor in Splenectomized and Nonsplenectomized Subjects," Molecular Therapy, Jan. 2012, vol. 20, No. 1, pp. 230-238.
Zarrabi et al., "Manipulation of Hematopoietic Stem Cell Fate by Small Molecule Compounds," Stem Cells and Development, 2018, vol. 27, Article No. 17, pp. 1175-1190.
Zonari et al., "Efficient Ex Vivo Engineering and Expansion of Highly Purified Human Hematopoietic Stem and Progenitor Cell Populations for Gene Therapy," Stem Cell Reports, Apr. 11, 2017, vol. 8, pp. 977-990.
Zuris et al., "Cationic lipid-mediated delivery of proteins enables efficient protein-based genome editing in vitro and in vivo," Nature Biotechnology, Jan. 2015, vol. 33, Article No. 1, pp. 73-80.
Micozzi et al., "Human cytidine deaminase: A biochemical characterization of its naturally occurring variants," International Journal of Biological Macromolecules, Feb. 2014, vol. 63, pp. 64-74 and pp. 75-91 containing Acknowledgments, Abbreviations, References, and Figures (28 total pages).

Ramakrishna et al., "Gene disruption by cell-penetrating peptide-mediated delivery of Cas9 protein and guide RNA," Genome Research, 2014, vol. 24, pp. 1020-1027.
Zhang et al., "Progress in base editing technology based on CRISPR/Cas9 system and its application in medical research," Chinese Journal of Pharmacology and Toxicology, Jul. 2018, vol. 32, No. 7, pp. 507-514 [English Abstract].
Hogan et al., "Differential long-term and multilineage engraftment potential from subtractions of human CD34+ cord blood cells transplanted into NOD/SCID mice," Proceedings of the National Academy of Sciences of the United States of America, Jan. 8, 2002, vol. 99, No. 1, pp. 413-418.
Hoggatt et al., "Rapid Mobilization Reveals a Highly Engraftable Hematopoietic Stem Cell," Cell, Jan. 11, 2018, vol. 172, pp. 191-204.
Huang et al., "Comparative analysis of three-dimensional chromosomal architecture identifies a novel fetal hemoglobin regulatory element," Genes & Development, 2017, vol. 31, pp. 1704-1713.
Juang et al., "Neutralizing negative epigenetic regulation by HDAC5 enhances human haematopoietic stem cell homing and engraftment," Nature Communications, 2018, vol. 9, No. 2741, pp. 1-13.
Husa et al., "Generation of CD34 Fluorescent Reporter Human Induced Pluripotent Stem Cells for Monitoring Hematopoietic Differentiation," Stem Cells and Development, 2018, pp. 1-34.
Kariko et al., "Suppression of RNA Recognition by Toll-like Receptors: The Impact of Nucleoside Modification and the Evolutionary Origin of RNA," Immunity, Aug. 2005, vol. 23, pp. 165-175.
Karponi et al., "Plerixafor+G-CSF-mobilized CD34+ cells represent an optimal graft source for thalassemia gene therapy," Blood, Jul. 30, 2015, vol. 126, No. 5, pp. 616-619.
Karpova et al., "Continuous blockade of CXCR4 results in dramatic mobilization and expansion of hematopoietic stem and progenitor cells," Blood, May 25, 2017, vol. 129, No. 21, pp. 2939-2949.
Karpova et al., "Mobilization of hematopoietic stem cells with the novel CXCR4 antagonist POL6326 (balixafortide) in healthy volunteers-results of a dose escalation trial," Journal of Translational Medicine, 2017, vol. 15, No. 2, pp. 1-12.
Kaya et al., "A bacterial Argonaute with noncanonical guide RNA specificity," Proceedings of the National Academy of Sciences of the United States of America, Apr. 12, 2016, vol. 113, No. 15, pp. 4057-4062.
Kim et al., "Genome-wide target specificity of CRISPR RNA-guided adenine base editors," Nature Biotechnology, Apr. 2019, vol. 37, pp. 430-435.
Kim et al., "Highly efficient RNA-guided genome editing in human cells via delivery of purified Cas9 ribonucleoproteins," Genome Research, 2014, vol. 24, pp. 1012-1019.
Kitko et al., "Preparing the Patient for HSCT: Conditioning Regimens and Their Scientific Rationale," Hematopoietic Stem Cell Transplantation for the Pediatric Hematologist/Oncologist, 2018, pp. 139-174.
Knapp et al., "Single-cell analysis identifies a CD33+ subset of human cord blood cells with high regenerative potential," Nature Cell Biology, Jun. 2018, vol. 20, pp. 710-720.
Komor et al., "CRISPR-Based Technologies for the Manipulation of Eukaryotic Genomes," Cell, Jan. 12, 2017, vol. 168, pp. 20-36.
Kury et al., "De Novo Disruption of the Proteasome Regulatory Subunit PSMD12 Causes a Syndromic Neurodevelopmental Disorder," The American Journal of Human Genetics, Feb. 2, 2017, vol. 100, pp. 352-363.
Kwon et al., "Anti-human CD117 antibody-mediated bone marrow niche clearance in nonhuman primates and humanized NSG mice," Blood, May 9, 2019, vol. 133, No. 19, pp. 2104-2108.
Lagresle-Peyrou et al., "Plerixafor enables the safe, rapid, efficient mobilization of haematopoietic stem cells in sickle cell disease patients after exchange transfusion," Haematologica, 2018, vol. 103, No. 5, pp. 778-786.
Lavergne et al., "Defects in type IIA von Willebrand disease: a cysteine 509 to arginine substitution in the mature von Willebrand factor disrupts a disulphide loop involved in the interaction with platelet glycoprotein Ib-IX," British Journal of Haematology, 1992, vol. 82, pp. 66-72.

(56) References Cited

OTHER PUBLICATIONS

Lee et al., "Cytosine base editor 4 but not adenine base editor generates off-target mutations in mouse embryos," Communications Biology, 2020, vol. 3, No. 19, pp. 1-6.

Leung et al., "Notch and AHR Signaling Impact Definitive Hematopoiesis from Human Pluripotent Stem Cells," Stem Cells, 2017, pp. 1-22.

Levasseur et al., "A Recombinant Human Hemoglobin with Antisickling Properties Greater than Fetal Hemoglobin," The Journal of Biological Chemistry, Jun. 25, 2004, vol. 279, No. 26, pp. 27518-27524.

Levasseur et al., "Correction of a mouse model of sickle cell disease: lentiviral/antisickling β-globin gene transduction of unmobilized, purified hematopoietic stem cells," Blood, Dec. 15, 2003, vol. 102, No. 13, pp. 4312-4319.

Levi et al., "Treosulfan induces distinctive gonadal toxicity compared with busulfan," Oncotarget, 2018, vol. 9, No. 27, pp. 19317-19327.

Li et al., "Isolation and transcriptome analyses of human erythroid progenitors: BFU-E and CFU-E," Blood, Dec. 4, 2014, vol. 124, No. 24, pp. 3636-3645.

Lidonnici et al., "Gene therapy and gene editing strategies for hemoglobinopathies," Blood Cells, Molecules, and Diseases, 2017, vol. 70, pp. 1-74.

Lidonnici et al., "Plerixafor and G-CSF combination mobilizes hematopoietic stem and progenitors cells with a distinct transcriptional profile and a reduced in vivo homing capacity compared to plerixafor alone," Haematologica, 2017, vol. 102, pp. e120-e124.

Liu et al., "Direct Promoter Repression by BCL11A Controls the Fetal to Adult Hemoglobin Switch," Cell, Apr. 19, 2018, vol. 173, pp. 1-13.

Martyn et al., "Natural regulatory mutations elevate the fetal globin gene via disruption of BCL11A or ZBTB7A binding," Nature Genetics, 2018, pp. 1-8.

Masuda et al., "Transcription factors LRF and BCL11A independently repress expression of fetal hemoglobin," Science, Jan. 15, 2016, vol. 351, Article No. 6270, pp. 285-289.

McDermott et al., "Comparison of human cord blood engraftment between immunocompromised mouse strains," Blood, Jul. 15, 2010, vol. 116, No. 2, pp. 193-200.

McIntosh et al., "Nonirradiated NOD,B6.SCID Il2rγ-/- Kit(W41/W41) (NBSGW) mice support multilineage engraftment of human hematopoietic cells," Stem Cell Reports, Feb. 10, 2015, vol. 4, pp. 171-180.

Medyouf, Hind, "The microenvironment in human myeloid malignancies: emerging concepts and therapeutic Implications," Blood, Mar. 23, 2017, vol. 129, No. 12, pp. 1617-1626.

Meng et al., "Substitutions in the beta subunits of sickle-cell hemoglobin improve oxidative stability and increase the delay time of sickle-cell fiber formation," The Journal of Biological Chemistry, 2019, vol. 294, No. 11, pp. 4145-4159.

Morrison et al., "A long noncoding RNA from the HBS1L-MYB intergenic region on chr6q23 regulates human fetal hemoglobin expression," Blood Cells, Molecules and Diseases, 2018, vol. 69, pp. 1-9.

Myers et al., "Fine Structure Genetic Analysis of a β-Globin Promoter," Science, May 2, 1986, vol. 232, pp. 613-618.

Niihara et al., "A Phase 3 trial of L-glutamine in sickle cell disease," The New England Journal of Medicine, Jul. 19, 2018, vol. 379, No. 3, pp. 226-235.

Notta et al., "Distinct routes of lineage development reshape the human blood hierarchy across ontogeny," Science, Jan. 8, 2016, vol. 351, Article No. 6269, aab2116, pp. 1-22.

Notta et al., "Engraftment of human hematopoietic stem cells is more efficient in female NOD/SCID/IL-2Rgc-null recipients," Blood, May 6, 2010, vol. 115, No. 18, pp. 3704-3707.

Notta et al., "Isolation of Single Human Hematopoietic Stem Cells Capable of Long-term Multilineage Engraftment," Science, Jul. 8, 2011, vol. 333, pp. 218-221.

Pagnier et al., "Polymerization and solubility of recombinant hemoglobins α2β2 6 Glu->Ala (Hb Makassar) and α2β2 6 Glu->Ala, 23 Val->Ile," Comptes Rendus de l Académie des Sciences—Series III—Sciences de la Vie, 1993, vol. 316, pp. 431-436.

Palchaudhuri et at, "Non-genotoxic conditioning for hematopoietic stem cell transplantation using a hematopoietic-cell-specific internalizing immunotoxin," Nature Biotechnology, Jul. 2016, vol. 34, No. 7, pp. 738-745.

Pang et al., "Anti-CD117 antibody depletes normal and myelodysplastic syndrome human hematopoietic stem cells in xenografted mice," Blood, May 9, 2019, vol. 133, No. 19, pp. 2069-2078.

Panyasai et al., "Hemoglobin Variants in Northern Thailand: Prevalence, Heterogeneity and Molecular Characteristics," Genetic Testing and Molecular Biomarkers, 2016, vol. 20, No. 1, pp. 37-43.

Park et al., "A Comprehensive, Ethnically Diverse Library of Sickle Cell Disease-Specific Induced Pluripotent Stem Cells," Stem Cell Reports, Apr. 11, 2017, vol. 8, pp. 1076-1085.

Piel et al., "Sickle Cell Disease," The New England Journal of Medicine, Apr. 20, 2017, vol. 376, No. 16, pp. 1561-1573.

Platt et al., "Mortality in Sickle Cell Disease: Life Expectancy and Risk Factors for Early Death," The New England Journal of Medicine, Jun. 9, 1994, vol. 330, No. 23, pp. 1639-1644.

Plosky, Brian S., "CRISPR-Mediated Base Editing without DNA Double-Strand Breaks," Molecular Cell, May 19, 2016, vol. 62, pp. 477-478.

Psatha et al., "Brief Report: A Differential Transcriptomic Profile of Ex Vivo Expanded Adult Human Hematopoietic Stem Cells Empowers Them for Engraftment Better than Their Surface Phenotype," Stem Cells Translational Medicine, 2017, vol. 6, pp. 1852-1858.

Psatha et al., "Disruption of the BCL11A Erythroid Enhancer Reactivates Fetal Hemoglobin in Erythroid Cells of Patients with β-Thalassemia Major," Molecular Therapy: Methods & Clinical Development, Sep. 2018, vol. 10, pp. 313-326.

U.S. Appl. No. 14/325,815, filed Jul. 6, 2021, Liu et al.

Addgene Plasmid No. 44246, Create Date Feb. 28, 2013.

Addgene Plasmid No. 73021, Create Date Apr. 20, 2016.

Addgene Plasmid No. 79620, Create Date Aug. 4, 2016.

Akinsheye et al., "Fetal hemoglobin in sickle cell anemia," Blood, Jul. 7, 2011, vol. 118, No. 1, pp. 19-27.

Alexander et al., "HFE-associated hereditary hemochromatosis," Genetics in Medicine, May 2009, vol. 11, No. 5, pp. 307-313.

Alexandrov et al., "Signatures of mutational processes in human cancer," Nature, Aug. 22, 2013, vol. 500, pp. 415-421.

Andries et al., "N1-methylpseudouridine-incorporated mRNA outperforms pseudouridine-incorporated mRNA by providing enhanced protein expression and reduced immunogenicity in mammalian cell lines and mice," Journal of Controlled Release, 2015, vol. 217, pp. 337-344.

Badran et al., "Continuous evolution of Bacillus thuringiensis toxins overcomes insect resistance," Nature, May 5, 2016, vol. 533, No. 7601, pp. 5863.

Bae et al., "Cas-OFFinder: a fast and versatile algorithm that searches for potential off-target sites of Cas9 RNA-guided endonucleases," Bioinformatics, Jan. 24, 2014, vol. 30, No. 10, pp. 1473-1475.

Billon et al., "CRISPR-Mediated Base Editing Enables Efficient Disruption of Eukaryotic Genes through Induction of STOP Codons," Molecular Cell, Sep. 21, 2017, vol. 67, pp. 1068-1079.

Branden and Tooze, "The Building Blocks," Introduction to Protein Structure, 1999, vol. 2, pp. 3-12.

Briner et al., "Guide RNA Functional Modules Direct Cas9 Activity and Orthogonality," Molecular Cell, Oct. 23, 2014, vol. 56, pp. 333-339.

Bulow et al., "Multienzyme systems obtained by gene fusion," Trends in Biotechnology, Jan. 1991, vol. 9, pp. 226-231.

Cai et al., "A Universal Approach to Correct Various HBB Gene Mutations in Human Stem Cells for Gene Therapy of Beta-Thalassemia and Sickle Cell Disease," Stem Cells Translational Medicine, 2018, vol. 7, pp. 87-97.

Cameron, Ewan R., "Recent Advances in Transgenic Technology," Molecular Biotechnology, 1997, vol. 7, pp. 253-265.

(56) References Cited

OTHER PUBLICATIONS

Canver et al., "Customizing the genome as therapy for the b-hemoglobinopathies," Blood, May 26, 2016, vol. 127, No. 21, pp. 2536-2545.
Chadwick et al., "In Vivo Base Editing of PCSK9 (Proprotein Convertase Subtilisin/Kexin Type 9) as a Therapeutic Alternative to Genome Editing," Arteriosclerosis, Thrombosis, and Vascular Biology, Sep. 2017, vol. 37, pp. 1741-1747.
Chatterjee et al., "A Cas9 with PAM recognition for adenine dinucleotides," Nature Communications, 2020, vol. 11, No. 2474, pp. 1-6.
Chester et al., "The apolipoprotein B mRNA editing complex performs a multifunctional cycle and suppresses honsense-mediated decay," The EMBO Journal, 2003, vol. 22, No. 15, pp. 3971-3982.
Chichili et al., "Linkers in the structural biology of protein-protein interactions," Protein Science, 2013, vol. 22, pp. 153-167.
Chylinski et al., "The tracrRNA and Cas9 families of type II CRISPR-Cas immunity systems," RNA Biology, May 2013, vol. 10, No. 5, pp. 726-737.
Collantes et al., "Development and Characterization of a Modular CRISPR and RNA Aptamer Mediated Base Editing System," The CRISPR Journal, 2021, vol. 4, No. 1, pp. 58-68.
Cong et al., "Multiplex Genome Engineering Using CRISPR/Cas Systems," Science, Feb. 15, 2013, vol. 339, No. 6121, pp. 819-823.
Deltcheva et al., "CRISPR RNA maturation by trans-encoded small RNA and host factor RNase III," Nature, Mar. 31, 2011, vol. 471, pp. 602-607.
Dever et al., "CRISPR/Cas9 β-globin gene targeting in human haematopoietic stem cells," Nature, Nov. 17, 2016, vol. 539, pp. 384-389.
Dever et al., "Preclinical Development of HBB Gene Correction in Autologous Hematopoietic Stem and Progenitor Cells to Treat Severe Sickle Cell Disease," Blood, 2017, vol. 130, No. Suppl. 1, p. 4620.
Dewitt et al., "Selection-free Genome Editing of the Sickle Mutation in Human Adult Hematopoietic Stem/Progenitor Cells," Science Translational Medicine, Oct. 12, 2016, vol. 8, No. 360, pp. 1-20.
Endo et al., "Toward establishing an efficient and versatile gene targeting system in higher plants," Biocatalysis and Agricultural Biotechnology, 2014, vol. 3, pp. 2-6.
Engelward et al., "Base excision repair deficient mice lacking the Aag alkyladenine DNA glycosylase," Proceedings of the National Academy of Sciences of the United States of America, Nov. 1997, vol. 94, pp. 13087-13092.
Esvelt et al., "A system for the continuous directed evolution of biomolecules," Nature, Apr. 28, 2011, vol. 472, No. 7344, pp. 499-503.
Ferretti et al., "Complete genome sequence of an M1 strain of *Streptococcus pyogenes*," Proceedings of the National Academy of Sciences of the United States of America, Apr. 10, 2001, vol. 98, No. 8, pp. 4658-4663.
Fitzhugh et al., "At least 20% donor myeloid chimerism is necessary to reverse the sickle phenotype after allogeneic HSCT," Blood, Oct. 26, 2017, vol. 130, No. 17, pp. 1946-1948.
Fonfara et al., "Phylogeny of Cas9 determines functional exchangeability of dual-RNA and Cas9 among orthologous type II CRISPR-Cas systems," Nucleic Acids Research, 2014, vol. 42, No. 4, pp. 2577-2590.
Forget, Bernard G., "Molecular Basis of Hereditary Persistence of Fetal Hemoglobin," Annals of the New York Academy of Sciences, 2006, vol. 850, No. 1, pp. 38-44.
Freshney et al., "Culture of Animal Cells, a Manual of Basic Technique," Food and Chemical Toxicology, 1983, vol. 23, No. 3, pp. 403-404.
Fu et al., "Human cell based directed evolution of adenine base editors with improved efficiency," Nature Communications, 2021, vol. 12, No. 5897, pp. 1-11.
Fukui et al., "DNA Mismatch Repair in Eukaryotes and Bacteria," Journal of Nucleic Acids, 2010, vol. 2010, No. 260512, pp. 1-16.

Gardlik et al., "Vectors and delivery systems in gene therapy," Medical Science Monitor, 2005, vol. 11, No. 4, pp. RA110-RA121.
Gasiunas et al., "Cas9-crRNA ribonucleoprotein complex mediates specific DNA cleavage for adaptive immunity in bacteria," Proceedings of the National Academy of Sciences of the United States of America, Sep. 4, 2012, pp. E2579-E2586.
Gasiunas et al., "RNA-dependent DNA endonuclease Cas9 of the CRISPR system: Holy Grail of genome editing?" Trends in Microbiology, Nov. 2013, vol. 21, No. 11, pp. 562-567.
Gaudelli et al., "Directed evolution of adenine base editors with increased activity and therapeutic application," Nature Biotechnology, 2020, pp. 1-15.
George et al., "Adenosine Deaminases Acting on RNA, RNA Editing, and Interferon Action," Journal of Interferon & Cytokine Research, 2011, vol. 31, No. 1, pp. 99-117.
Gerber et al., "An Adenosine Deaminase that Generates Inosine at the Wobble Position of tRNAs," Science, Nov. 5, 1999, vol. 286, pp. 1146-1149.
Geu-Flores et al., "USER fusion: a rapid and efficient method for simultaneous fusion and cloning of multiple PCR products," Nucleic Acids Research, 2007, vol. 35, No. 7, e55, pp. 1-6.
Grunebaum et al., "Recent advances in understanding and managing adenosine deaminase and purine nucleoside phosphorylase deficiencies," Current Opinion in Allergy and Clinical Immunology, Dec. 2013, vol. 13, No. 6, pp. 630-638.
Grunewald et al., "CRISPR DNA base editors with reduced RNA off-target and self-editing activities," Nature Biotechnology, Sep. 2019, vol. 37, No. 9, pp. 1041-1048.
Grunewald et al., "Transcriptome-wide off-target RNA editing induced by CRISPR-guided DNA base editors," Nature, May 2019, vol. 569, No. 7756, pp. 433-437.
Guilinger et al., "Fusion of catalytically inactive Cas9 to FokI nuclease improves the specificity of genome modification," Nature Biotechnology, 2014, pp. 1-6.
Guo et al., "Protein tolerance to random amino acid change," Proceedings of the National Academy of Sciences of the United States of America, Jun. 22, 2004, vol. 101, No. 25, pp. 9205-9210.
Hiess et al., "Methods and Applications of CRISPR-Mediated Base Editing in Eukaryotic Genomes," Molecular Cell, Oct. 5, 2017, vol. 68, pp. 26-43.
Schrank et al., "Inactivation of the survival motor neuron gene, a candidate gene for human spinal muscular atrophy, leads to massive cell death in early mouse embryos," Proceedings of the National Academy of Sciences of the United States of America, Sep. 1997, vol. 94, pp. 9920-9925.
Shin et al., "High c-Kit expression identifies hematopoietic stem cells with impaired self-renewal and megakaryocytic bias," The Journal of Experimental Medicine, 2014, vol. 211, No. 2, pp. 217-231.
Singh et al., "Splicing of a Critical Exon of Human Survival Motor Neuron Is Regulated by a Unique Silencer Element Located in the Last Intron," Molecular and Cellular Biology, Feb. 2006, vol. 26, No. 4, pp. 1333-1346.
Tang et al., "Aptazyme-embedded guide RNAs enable ligand-responsive genome editing and transcriptional activation," Nature Communications, 2017, vol. 8, Article No. 15939, pp. 1-8.
Talbot et al., "Spinal muscular atrophy," Journal of Inherited Metabolic Disease, Jun. 2001, vol. 21, No. 2, pp. 189-197 [Abstract Only].
UniProt Accession No. P51908, Downloaded Jan. 9, 2024.
Wirth et al., "Mildly affected patients with spinal muscular atrophy are partially protected by an increased SMN2 copy number," Human Genetics, 2006, vol. 119, pp. 422-428.
Gaudelli et al., "Programmable base editing of A:T to G:C in genomic DNA without DNA cleavage," Nature, Nov. 23, 2017, vol. 551, No. 7681, pp. 464-471.
Sangkitporn et al., "Hb G Makassar (Beta 6: Glu-Ala) in a Thai family," Journal of the Medical Association of Thailand, 2002, vol. 85, pp. 557-582.
International Search Report and Written Opinion in corresponding International Patent Application No. PCT/US19/31897, mailed Oct. 18, 2019 (13 pages).

(56) References Cited

OTHER PUBLICATIONS

Cartegni et al., "Determinants of Exon 7 Splicing in the Spinal Muscular Atrophy Genes, SMN1 and SMN2," The American Journal of Human Genetics, Jan. 2006, vol. 78, pp. 63-77.
Chang et al., "Degradation of survival motor neuron (SMN) protein is mediated via the ubiquitin/proteasome pathway," Neurochemistry International, 2004, vol. 45, pp. 1107-1112.
Cho et al., "A degron created by SMN2 exon 7 skipping is a principal contributor to spinal muscular atrophy severity," Genes & Development, 2010, vol. 24, pp. 438-442.
Corcia et al., "The importance of the SMN genes in the genetics of sporadic ALS," Amyotrophic Lateral Sclerosis, 2009, vol. 10, pp. 436-440.
Corti et al., "Genetic Correction of Human Induced Pluripotent Stem Cells from Patients with Spinal Muscular Atrophy," Science Translational Medicine, Dec. 19, 2012, vol. 4, Article No. 165, pp. 1-20 and pp. 21-32 containing Figures (32 total pages).
Couch et al., "Human erythroblasts with c-Kit activating mutations have reduced cell culture costs and remain capable of terminal maturation," Experimental Hematology, Jun. 2019, vol. 74, pp. 19-24 and pp. 24.e1-24.e4 containing Supplemental Methods and Supplemental References (10 total pages).
Cucchiarini et al., "Enhanced expression of the central survival of motor neuron (SMN) protein during the pathogenesis of osteoarthritis," Journal of Cellular and Molecular Medicine, 2014, vol. 18, No. 1, pp. 115-124.
Doudna, Jennifer A., "The Promise and Challenge of Therapeutic Genome Editing," Nature, Feb. 2020, vol. 578, Article No. 7794, pp. 229-236 and pp. 20-24 containing Figures (24 total pages).
D'Ydewalle et al., "The Antisense Transcript SMN-AS1 Regulates SMN Expression and Is a Novel Therapeutic Target for Spinal Muscular Atrophy," Neuron, Jan. 4, 2017, vol. 93, pp. 63-79.
GenBank Accession No. AIT42264.1, downloaded Jan. 9, 2024.
GenBank Accession No. AKA60242.1, downloaded Jan. 9, 2024.
GenBank Accession No. AKQ21048.1, downloaded Jan. 9, 2024.
GenBank Accession No. AKS40380.1, downloaded Jan. 9, 2024.
GenBank Protein No. 4UN5_B, downloaded Jan. 9, 2024.
Hendel et al., "Chemically modified guide RNAs enhance CRISPR-Cas genome editing in human primary cells," Nature Biotechnology, Sep. 2015, vol. 33, Article No. 9, pp. 985-989 and pp. 13-14 containing Figures (14 total pages).
Le et al., "SMNΔ7, the major product of the centromeric survival motor neuron (SMN2) gene, extends survival in mice with spinal muscular atrophy and associates with full-length SMN," Human Molecular Genetics, 2005, vol. 14, No. 6, pp. 845-857.
Lefebvre et al., "Identification and Characterization of a Spinal Muscular Atrophy-Determining Gene," Jan. 13, 1995, vol. 80, pp. 155-165.
Lin et al., "[Construction and evaluation of DnaB split intein high expression vector and a six amino acids cyclic peptide library]," Chinese Journal of Biotechnology, Nov. 1, 2008, vol. 24, No. 11, pp. 1924-1930 [English Abstract Only].
Lorson et al., "A single nucleotide in the SMN gene regulates splicing and is responsible for spinal muscular atrophy," Proceedings of the National Academy of Sciences of the United States of America, May 1999, vol. 96, pp. 6307-6311.
Lutz et al., "Postsymptomatic restoration of SMN rescues the disease phenotype in a mouse model of severe spinal muscular atrophy," The Journal of Clinical Investigation, Aug. 2011, vol. 121, No. 8, pp. 3029-3041.
Monani et al., "A single nucleotide difference that alters splicing patterns distinguishes the SMA gene SMN1 from the copy gene SMN2," Human Molecular Genetics, 1999, vol. 8, No. 7, pp. 1177-1183.
Murray et al., "Selective vulnerability of motor neurons and dissociation of pre- and post-synaptic pathology at the neuromuscular junction in mouse models of spinal muscular atrophy," Human Molecular Genetics, 2008, vol. 17, No. 7, pp. 949-962.
NCBI Reference Sequence No. NC_000001.11, downloaded Jan. 9, 2024.
NCBI Reference Sequence No. WP_002989955.1, downloaded Jan. 9, 2024.
NCBI Reference Sequence No. WP_010922251.1, downloaded Jan. 9, 2024.
NCBI Reference Sequence No. WP_011054416.1, downloaded Jan. 9, 2024.
NCBI Reference Sequence No. WP_011284745.1, downloaded Jan. 9, 2024.
NCBI Reference Sequence No. WP_011285506.1, downloaded Jan. 9, 2024.
NCBI Reference Sequence No. WP_011527619.1, downloaded Jan. 9, 2024.
NCBI Reference Sequence No. WP_012560673.1, downloaded Jan. 9, 2024.
NCBI Reference Sequence No. WP_014407541.1, downloaded Jan. 9, 2024.
NCBI Reference Sequence No. WP_020905136.1, downloaded Jan. 9, 2024.
NCBI Reference Sequence No. WP_023080005.1, downloaded Jan. 9, 2024.
NCBI Reference Sequence No. WP_023610282.1, downloaded Jan. 9, 2024.
NCBI Reference Sequence No. WP_030125963.1, downloaded Jan. 9, 2024.
NCBI Reference Sequence No. WP_030126706.1, downloaded Jan. 9, 2024.
NCBI Reference Sequence No. WP_031488318.1, downloaded Jan. 9, 2024.
NCBI Reference Sequence No. WP_032460140.1, downloaded Jan. 9, 2024.
NCBI Reference Sequence No. WP_032461047.1, downloaded Jan. 9, 2024.
NCBI Reference Sequence No. WP_032462016.1, downloaded Jan. 9, 2024.
NCBI Reference Sequence No. WP_032462936.1, downloaded Jan. 9, 2024.
NCBI Reference Sequence No. WP_032464890.1, downloaded Jan. 9, 2024.
NCBI Reference Sequence No. WP_038431314.1, downloaded Jan. 9, 2024.
NCBI Reference Sequence No. WP_038432938.1, downloaded Jan. 9, 2024.
NCBI Reference Sequence No. WP_038434062.1, downloaded Jan. 9, 2024.
NCBI Reference Sequence No. WP_048327215.1, downloaded Jan. 9, 2024.
NCBI Reference Sequence No. WP_049519324.1, downloaded Jan. 9, 2024.
Nelson et al., "In vivo genome editing improves muscle function in a mouse model of Duchenne muscular dystrophy," Science, Jan. 22, 2016, vol. 351, No., 6271, pp. 403-407.
Ousterout et al., "Multiplex CRISPR/Cas9-based genome editing for correction of dystrophin mutations that cause Duchenne muscular dystrophy," Nature Communications, vol. 6, No. 6244, pp. 1-13.
Sang et al., "A unique uracil-DNA binding protein of the uracil DNA glycosylase superfamily," Nucleic Acids Research, Sep. 30, 2015, vol. 43, No. 17, pp. 8452-8463.
Aratyn-Schaus et al., "[589] Base-Editing as a Therapeutic Approach for the Direct Correction of Disease-Causing Mutations Underlying Glycogen Storage Disease Type IA," AASLD Abstracts (Poster), Hepatology, Oct. 2020, vol. 72, No. Suppl. 1, pp. 354A-355A.
Azad et al., "Site-directed RNA editing by adenosine deaminase acting on RNA for correction of the genetic code in gene therapy," Gene Therapy, 2017, vol. 24, pp. 779-786.
Baligar et al., "Bone Marrow Stem Cell Therapy Partially Ameliorates Pathological Consequences in Livers of Mice Expressing Mutant Human α1-Antitrypsin," Hepatology, Apr. 2017, vol. 65, No. 4, pp. 1319-1335.
Bjursell et al., "Therapeutic Genome Editing With CRISPR/Cas9 in a Humanized Mouse Model Ameliorates α1-antitrypsin Deficiency Phenotype," EBioMedicine, 2018, vol. 29, pp. 104-111.

(56) References Cited

OTHER PUBLICATIONS

Fagagna et al., "The Gam protein of bacteriophage Mu is an orthologue of eukaryotic Ku," EMBO reports, 2003, vol. 4, No. 1, pp. 47-52.
GenBank Locus No. LC169509.1, downloaded Aug. 10, 2023.
GenBank NCBI Reference Sequence No. NM_000295.4, downloaded Aug. 23, 2023.
Greene et al., "Alpha-1 Antitrypsin Deficiency: Recent Developments in Gene Therapy Research," Gene Therapy Application, 2011, vol. 25, pp. 449-460.
Jha et al., "Single amino acid substitutions in recombinant plant-derived human α1-proteinase inhibitor confer enhanced stability and functional efficacy," Biochimica et Biophysica Acta, 2014, vol. 1840, pp. 416-427.
Kleinstiver et al., "Broadening the targeting range of Staphylococcus aureus CRISPR-Cas9 by modifying PAM recognition," Nature Biotechnology, Dec. 2015, vol. 33, No. 12, pp. 1293-1298 and p. 1299 containing Online Methods (7 total pages).
Lei et al., "Glucose-6-phosphatase dependent substrate transport in the glycogen storage disease type-1a mouse," Nature Genetics, Jun. 1996, vol. 13, pp. 203-209.
Li et al., "Gene Therapy Advances of CRISPR/Cas9 in β-thalassaemia," International Journal of Gynecology & Obstetrics, Apr. 2017, vol. 44, No. 2, pp. 185-188 [English Abstract].
NCBI Reference Sequence No. NP_000286.3, downloaded Sep. 27, 2023.
Pournasr et al., "Modeling Inborn Errors of Hepatic Metabolism Using Induced Pluripotent Stem Cells," Arteriosclerosis, Thrombosis, and Vascular Biology, Nov. 2017, vol. 37, pp. 1994-1999.
Qianqian, Xiong, "Advances in Diagnosis and Treatment of Glycogen Storage Diseases," Journal of Stroke and Neurological Diseases, 2017, vol. 34, No. 10, pp. 957-960 [English Abstract].
Qing et al., "Research progress on double-stranded RNA-specific adenosine deaminase—DSRAD/ADAR1," Foreign Medical Sciences, 2004, vol. 3, pp. 129-132 [English Abstract Only].
Rajamohan et al., "Current status of drug screening and disease modelling in human pluripotent stem cells," Bioessays, 2012, vol. 35, pp. 281-298.
Ribeiro et al., "Protein Engineering Strategies to Expand CRISPR-Cas9 Applications," Hindawi: International Journal of Genomics, 2018, vol. 2018, Article No. 1652567, pp. 1-12.
Ryu et al., "Adenine base editing in mouse embryos and an adult mouse model of Duchenne muscular dystrophy," Nature Biotechnology, Jun. 2018, vol. 36, No. 6, pp. 536-539.
Shah et al., "Efficient and versatile CRISPR engineering of human neurons in culture to model neurological disorders," Wellcome Open Research, Nov. 15, 2016, vol. 1, No. 13, pp. 1-18 and pp. 19-21 containing Open Peer Review (21 total pages).
Shah et al., "MeCP2 mutations: progress towards understanding and treating Rett syndrome," Genome Medicine, 2017, vol. 9, No. 17, pp. 1-4.
Shee et al., "Engineered proteins detect spontaneous DNA breakage in human and bacterial cells," eLife, 2013, vol. 2, No. e01222, pp. 1-25.
Shen et al., "Amelioration of Alpha-1 Antitrypsin Deficiency Diseases with Genome Editing in Transgenic Mice," Human Gene Therapy, 2018, vol. 29, No. 8, pp. 861-873.
Sinnamon et al., "Site-directed RNA repair of endogenous Mecp2 RNA in neurons," Proceedings of the National Academy of Sciences of the United States of America, Oct. 16, 2017, pp. E9395-E9402.
Smith et al., "Efficient and Allele-Specific Genome Editing of Disease Loci in Human iPSCs," Molecular Therapy, Mar. 2015, vol. 23, No. 3, pp. 570-577.
Valdmanis et al., "Future of rAAV Gene Therapy: Platform for RNAi, Gene Editing, and Beyond," Human Gene Therapy, 2017, vol. 28, No. 4, pp. 361-372.
Wei et al., "The "new favorite" of gene editing technology-single base editors," Hereditas, 2017, vol. 39, No. 12, pp. 1115-1121 [English Abstract].
Werder et al., "Adenine base editing reduces misfolded protein accumulation and toxicity in alpha-1 antitrypsin deficient patient iPSC-hepatocytes," Molecular Therapy, Nov. 2021, vol. 29, No. 11, pp. 3219-3229.
Yang et al., "APOBEC: From mutator to editor," Journal of Genetics and Genomics, 2017, vol. 44, pp. 423-437.
Yuliang et al., "Diagnosis and treatment of α1-antitrypsin deficiency," Practical Clinical Medicine, 2017, vol. 2, pp. 104-107 [English Abstract Only].
Maas et al., Identification and characterization of a human tRNA-specific adenosine deaminase related to the ADAR family of pre-mRNA editing enzymes, Proceedings of the National Academy of Sciences of the United States of America, Aug. 1999, vol. 96, pp. 8895-8900.
MacBeth et al., "Inositol Hexakisphosphate is Bound in the ADAR2 Core and Required for RNA Editing," Science, Sep. 2, 2002, vol. 309, No. 5740, pp. 1534-1539.
Makarova et al., "Classification and Nomenclature of CRISPR-Cas Systems: Where from Here?," The CRISPR Journal, 2018, vol. 1, No. 5, pp. 325-336.
Malashkevich et al., "Crystal structure of tRNA adenosine deaminase TadA from *Escherichia coli*," Worldwide Protein Data Bank, Jan. 23, 2021, vol. 1Z3A, pp. 1-13.
Mali et al., "Cas9 as a versatile tool for engineering biology," Nature Methods, Oct. 2013, vol. 10, No. 10, pp. 957-963.
Mali et al., "CAS9 transcriptional activators for target specificity screening and paired nickases for cooperative genome engineering," Nature Biotechnology, 2013, pp. 1-6.
Matsoukas, Ianis G., "Commentary: Programmable base editing of A•T to G•C in genomic DNA without DNA cleavage," Frontiers in Genetics, Feb. 2018, vol. 9, No. 21, pp. 1-4.
Matthews et al., "Structures of human ADAR2 bound to dsRNA reveal base-flipping mechanism and basis for site selectivity," Nature Structural & Molecular Biology, May 2016, vol. 23, No. 5, pp. 426-433.
McCann et al., "MagnEdit-interacting factors that recruit DNA-editing enzymes to single base targets," Life Science Alliance, 2020, vol. 3, No. 4, e201900606, pp. 1-9.
Mikami et al., "Comparison of CRISPR/Cas9 expression constructs for efficient targeted mutagenesis in rice," Plant Molecular Biology, 2015, vol. 88, pp. 561-572.
Miller et al., "Continuous evolution of SpCas9 variants compatible with non-G PAMs," Nature Biotechnology, Apr. 2020, vol. 38, No. 4, pp. 471-481.
Mohamad et al., "Human hemoglobin G-Makassar variant masquerading as sickle cell anemia," Hematology Reports, 2018, vol. 10, No. 7210, pp. 92-95.
Muller et al., "Nucleotide exchange and excision technology (NExT) DNA shuffling: a robust method for DNA fragmentation and directed evolution," Nucleic Acids Research, 2005, vol. 33, No. 13, e117, pp. 1-9.
Mullins et al., "Transgenesis in Nonmurine Species," Hypertension, Oct. 1993, vol. 22, No. 4, pp. 630-633.
Musallam et al., "Fetal hemoglobin levels and morbidity in untransfused patients with β-thalassemia intermedia," Blood, Jan. 12, 2012, vol. 119, No. 2, 364-367.
Navaratnam et al., "An Overview of Cytidine Deaminases," International Journal of Hematology, 2006, vol. 83, pp. 195-200.
Ngo et al., "Fetal haemoglobin levels and haematological characteristics of compound heterozygotes for haemoglobin S and deletional hereditary persistence of fetal haemoglobin," British Journal of Haematology, 2011, vol. 156, pp. 259-264.
Nishida et al., "Targeted Nucleotide Editing Using Hybrid Prokaryotic and Vertebrate Adaptive Immune Systems," Science, Sep. 16, 2016, vol. 353, No. 6305, p. aaf8721-aaf87219.
Nishimasu et al., "Engineered CRISPR-Cas9 nuclease with expanded targeting space," Science, Sep. 21, 2018, vol. 361, pp. 1259-1262.
Oakes et al., "CRISPR-Cas9 Circular Permutants as Programmable Scaffolds for Genome Modification," Cell, Jan. 10, 2019, vol. 176, pp. 254-267.
Okumura et al., "Evolutionary paths of streptococcal and staphylococcal superantigens," BMC Genomics, 2012, vol. 13, No. 404, pp. 1-16.

(56) References Cited

OTHER PUBLICATIONS

Paquet et al., "Efficient introduction of specific homozygous and heterozygous mutations using CRISPR/Cas9," Nature, May 5, 2016, vol. 533, pp. 125-129.
Park et al., "Digenome-seq web tool for profiling CRISPR specificity," Nature Methods, Jun. 2017, vol. 14, No. 6, pp. 548-549.
Parr et al., "N1-Methylpseudouridine substitution enhances the performance of synthetic mRNA switches in cells," Nucleic Acids Research, 2020, vol. 48, No. 6, e35, pp. 1-9.
Pattanayak et al., "High-throughput profiling of off-target DNA cleavage reveals RNA-programmed Cas9 nuclease specificity," Nature Biotechnology, Sep. 2013, vol. 31, No. 9, pp. 839-843.
Pausch et al., "CRISPR-CasΦ from huge phages is a hypercompact genome editor," Science, Jul. 17, 2020, vol. 369, No. 6501, pp. 333-337.
Phillips, Anthony J., "The challenge of gene therapy and DNA delivery," Journal of Pharmacy and Pharmacology, 2001, vol. 53, pp. 1169-1174.
Poller et al., "A Leucine-to-Proline Substitution Causes a Defective α1-Antichymotrypsin Allele Associated with Familial Obstructive Lung Disease," Genomics, 1993, vol. 17, pp. 740-743.
Putnam et al., "Protein Mimicry of DNA from Crystal Structures of the Uracil-DNA Glycosylase Inhibitor Protein and its Complex with *Escherichia coli* Uracil-DNA Glycosylase," Journal of Molecular Biology, 1999, vol. 287, pp. 331-346.
Qi et al., "Repurposing CRISPR as an RNA-Guided Platform for Sequence-Specific Control of Gene Expression," Cell, Feb. 28, 2013, vol. 152, pp. 1173-1183.
Ran et al., "In vivo genome editing using Staphylococcus aureus Cas9," Nature, Apr. 9, 2015, vol. 520, No. 7546, pp. 186-191.
Rees et al., "Analysis and minimization of cellular RNA editing by DNA adenine base editors," Science Advances, May 8, 2019, vol. 5, No. eaax5717, pp. 1-10.
Rees et al., "Base editing: precision chemistry on the genome and transcriptome of living cells," Nature Reviews Genetics, Dec. 2018, vol. 19, No. 12, pp. 770-788.
Rees et al., "Improving the DNA specificity and applicability of base editing through protein engineering and protein delivery," 2017, vol. 8, No. 15790, pp. 1-10.
Richter et al., "Phage-assisted evolution of an adenine base editor with improved Cas domain compatibility and activity," Nature Biotechnology, Jul. 2020, vol. 38, No. 7, pp. 883-891.
Rubio et al., "An adenosine-to-inosine tRNA-editing enzyme that can perform C-to-U deamination of DNA," Proceedings of the National Academy of Sciences of the United States of America, May 8, 2007, vol. 104, No. 19, pp. 7821-7826.
Sang, Helen, "Prospects for transgenesis in the chick," Mechanisms of Development, 2004, vol. 121, pp. 1179-1186.
Saparbaev et al., "Excision of hypoxanthine from DNA containing dIMP residues by the *Escherichia coli*, yeast, rat, and human alkylpurine DNA glycosylases," Proceedings of the National Academy of Sciences of the United States of America, Jun. 1994, vol. 91, pp. 5873-5877.
Satomura et al., "Precise genome-wide base editing by the CRISPR Nickase system in yeast," Scientific Reports, 2017, vol. 7, No. 2095, pp. 1-10.
Shi et al., "Structural basis for targeted DNA cytosine deamination and mutagenesis by APOBEC3A and APOBEC3B," Nature Structural & Molecular Biology, Feb. 2017, vol. 24, No. 2, pp. 131-139.
Shimomura et al., "Complete genome sequencing and analysis of a Lancefield group G *Streptococcus dysgalactiae* subsp. equisimilis strain causing streptococcal toxic shock syndrome (STSS)," BMC Genomics, 2011, vol. 12, No. 17, pp. 1-17.
Shmakov et al., "Discovery and Functional Characterization of Diverse Class 2 CRISPR-Cas Systems," Molecular Cell, Nov. 5, 2015, vol. 60, pp. 385-397.
Slaymaker et al., "Rationally engineered Cas9 nucleases with improved specificity," Science, Jan. 1, 2016, vol. 351, No. 6268, pp. 84-88.
Tan et al., "Engineering of high-precision base editors for site-specific single nucleotide replacement," Nature Communications, 2019, vol. 10, No. 439, pp. 1-10.
Tanenbaum et al., "A Protein-Tagging System for Signal Amplification in Gene Expression and Fluorescence Imaging," Cell, Oct. 23, 2014, vol. 159, pp. 635-646.
Tang et al., "Aptazyme-embedded guide RNAs enable ligand-responsive genome editing and transcriptional activation," Nature Communications, 2017, vol. 8, No. 15939, pp. 1-8.
Teng et al., "Mutational analysis of apolipoprotein B mRNA editing enzyme (APOBEC1): structure-function relationships of RNA editing and dimerization," Journal of Lipid Research, 1999, vol. 40, pp. 623-635.
Townsend et al., "Role of HFE in iron metabolism, hereditary haemochromatosis, anaemia of chronic disease, and secondary iron overload," The Lancet, Mar. 2, 2002, vol. 359, pp. 786-790.
Traxler et al., "A genome-editing strategy to treat β-hemoglobinopathies that recapitulates a mutation associated with a benign genetic condition, " Nature Medicine, Sep. 2016, vol. 22, No. 9, pp. 987-990.
Tsai et al., "GUIDE-seq enables genome-wide profiling of off-target cleavage by CRISPR-Cas nucleases," Nature Biotechnology, Feb. 2015, vol. 33, No. 2, pp. 187-197.

\* cited by examiner

| | | 1 | 2 | 3 | 4 | 5 | 6 | 7 | 8 |
|---|---|---|---|---|---|---|---|---|---|
| Normal Hb A | DNA | CAC | GTG | GAC | TGA | GGA | CTC | CTC | TTC |
| | mRNA | GUG | CAC | CUG | ACU | CCU | GAG | GAG | AAG |
| | Amino acid | val | his | leu | thr | pro | glu | glu | lys |
| Sickle Hb S | DNA | CAC | GTG | GAC | TGA | GGA | CAC | CTC | TTC |
| | mRNA | GUG | CAC | CUG | ACU | CCU | GUG | GAG | AAG |
| | Amino acid | val | his | leu | thr | pro | val | glu | lys |
| Hb C | DNA | CAC | GTG | GAC | TGA | GGA | TTC | CTC | TTC |
| | mRNA | GUG | CAC | CUG | ACU | CCU | AAG | GAG | AAG |
| | Amino acid | val | his | leu | thr | pro | lys | glu | lys |
| Hb Makassar | DNA | CAC | GTG | GAC | TGA | GGA | CGC | CTC | TTC |
| | mRNA | GUG | CAC | CUG | ACU | CCU | GCG | GAG | AAG |
| | Amino acid | val | his | leu | thr | pro | ala | glu | lys |

FIG. 6

| gRNA | Target sequence + PAM | ABE editor | Desired Editing position | Off target editing position |
|---|---|---|---|---|
| HBB gRNA1 | TCCACAGGAGTCAGATGCACCATGGT | SA Cas9 KKH | A4 | A6, A9, A13 |
| HBB gRNA2 | ACTTCTCCACAGGAGTCAGATGCA | SP Cas9 MQKSER | A9 | A11 |
| HBB gRNA3 | CAGACTTCTCCACAGGAGTCAGA | SP Cas9 VRQR | A12 | A4 |
| HBB gRNA4 | GGCAGACTTCTCCACAGGAGTCAGAT | SA Cas9 KKH | A14 | A6 |

FIG. 7A

| HEK2 Site | 1 | 2 | 3 | 4 | 5 | 6 | 7 | 8 | 9 | 10 |
|---|---|---|---|---|---|---|---|---|---|---|
| A | 0.01 | 99.95 | 99.14 | 0.02 | 28.39 | 0 | 75.84 | 99.07 | 98.98 | 0 |
| C | 0 | 0 | 0 | 99.97 | 0.01 | 99.83 | 0.06 | 0 | 0 | 0 |
| G | 99.9 | 0.05 | 0.84 | 0 | 71.6 | 0.13 | 24.08 | 0.92 | 1.02 | 99.9 |
| T | 0 | 0 | 0.02 | 0.01 | 0.01 | 0.03 | 0.02 | 0 | 0 | 0 |

FIG. 9A

| | PAM | | | 20 | 19 | 18 | 17 | 16 | 15 | 14 | 13 | 12 | 11 | 10 | 9 | 8 | 7 | 6 | 5 | 4 | 3 | 2 | 1 |
|---|---|---|---|---|---|---|---|---|---|---|---|---|---|---|---|---|---|---|---|---|---|---|---|
| | T | C | T | A | g | G | T | A | T | G | A | T | T | G | A | A | L | A | A | T | C |

ABE ST1-CAS9

| | | | | | | | | | | | | | | | | | | | | | | | |
|---|---|---|---|---|---|---|---|---|---|---|---|---|---|---|---|---|---|---|---|---|---|---|---|
| A | 0.0 | 0.0 | 0.0 | 100.0 | 0.0 | 0.0 | 0.0 | 0.0 | 100.0 | 0.0 | 0.0 | 0.0 | 0.0 | 100.0 | 0.0 | 0.0 | 100.0 | 0.0 | 0.0 | 100.0 | 0.0 | 100.0 | 0.0 | 0.1 |
| C | 0.0 | 99.9 | 0.0 | 0.0 | 0.0 | 0.0 | 0.0 | 0.0 | 0.0 | 0.0 | 13.1 | 0.0 | 7.6 | 0.0 | 0.0 | 0.0 | 0.0 | 11.1 | 0.0 | 0.0 | 0.0 | 0.0 | 2.5 | 99.9 |
| G | 0.0 | 0.0 | 0.0 | 0.0 | 99.9 | 100.0 | 0.0 | 0.0 | 0.0 | 0.0 | 0.0 | 99.9 | 0.0 | 0.0 | 99.9 | 0.0 | 0.0 | 0.0 | 99.9 | 0.0 | 0.0 | 0.0 | 0.0 | 0.0 |
| T | 100.0 | 0.1 | 100.0 | 0.0 | 0.0 | 0.0 | 100.0 | 100.0 | 0.0 | 99.9 | 86.9 | 0.0 | 92.4 | 0.0 | 0.1 | 99.4 | 0.0 | 88.9 | 0.1 | 0.0 | 100.0 | 0.0 | 97.5 | 0.0 |

UNTREATED

| | | | | | | | | | | | | | | | | | | | | | | | |
|---|---|---|---|---|---|---|---|---|---|---|---|---|---|---|---|---|---|---|---|---|---|---|---|
| A | 0.0 | 0.0 | 0.0 | 100.0 | 0.0 | 0.0 | 0.0 | 0.0 | 100.0 | 0.0 | 0.0 | 0.0 | 0.0 | 100.0 | 0.0 | 0.0 | 100.0 | 0.0 | 0.0 | 100.0 | 0.0 | 100.0 | 0.0 | 0.0 |
| C | 0.0 | 100.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 99.9 |
| G | 0.0 | 0.0 | 0.0 | 0.0 | 100.0 | 100.0 | 0.0 | 0.0 | 0.0 | 0.0 | 0.0 | 100.0 | 0.0 | 0.0 | 99.9 | 0.0 | 0.0 | 0.0 | 100.0 | 0.0 | 0.0 | 0.0 | 0.0 | 0.0 |
| T | 100.0 | 0.0 | 100.0 | 0.0 | 0.0 | 0.0 | 100.0 | 100.0 | 0.0 | 100.0 | 100.0 | 0.0 | 100.0 | 0.0 | 0.0 | 100.0 | 0.0 | 100.0 | 0.0 | 0.0 | 100.0 | 0.0 | 100.0 | 0.0 |

| | INDEL % |
|---|---|
| ABE-ST1 CAS9 | 0.30% |
| ST1-CAS9 NUCLEASE | 18.0% |
| UNTREATED | 0.051% |

ABE ST1-CAS9

| | 1 | 2 | 3 | 4 | 5 | 6 | 7 | 8 | 9 | 10 | 11 | 12 | 13 | 14 | 15 | 16 | 17 | 18 | 19 | 20 | P | A | M | | | |
|---|---|---|---|---|---|---|---|---|---|---|---|---|---|---|---|---|---|---|---|---|---|---|---|---|---|---|
| | G | C | T | G | A | A | T | G | A | A | G | T | T | A | T | G | A | T | C | G | N | N | A | G | A | A |
| A | 0.0 | 0.0 | 0.0 | 0.1 | 98.8 | 96.3 | 0.0 | 0.0 | 96.1 | 95.0 | 0.0 | 0.0 | 0.0 | 95.5 | 0.0 | 0.0 | 100.0 | 0.0 | 0.0 | 0.0 | 100.0 | 100.0 | 100.0 | 0.0 | 100.0 | 100.0 |
| C | 99.9 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 99.9 | 0.0 | 0.0 | 0.0 | 0.0 | 0.0 | 0.0 | 0.0 |
| G | 0.0 | 0.0 | 99.9 | 0.0 | 1.2 | 3.7 | 0.0 | 99.9 | 3.9 | 5.0 | 99.9 | 0.0 | 0.0 | 4.5 | 0.0 | 100.0 | 0.0 | 0.0 | 0.0 | 99.9 | 0.0 | 0.0 | 0.0 | 99.9 | 0.0 | 0.0 |
| T | 0.0 | 100.0 | 0.0 | 0.0 | 0.0 | 0.0 | 100.0 | 0.1 | 0.0 | 0.0 | 0.0 | 100.0 | 100.0 | 0.0 | 100.0 | 0.0 | 0.0 | 100.0 | 0.0 | 0.0 | 0.0 | 0.0 | 0.0 | 0.0 | 0.0 | 0.0 |

UNTREATED

| | 1 | 2 | 3 | 4 | 5 | 6 | 7 | 8 | 9 | 10 | 11 | 12 | 13 | 14 | 15 | 16 | 17 | 18 | 19 | 20 | P | A | M | | | |
|---|---|---|---|---|---|---|---|---|---|---|---|---|---|---|---|---|---|---|---|---|---|---|---|---|---|---|
| | G | C | T | G | A | A | T | G | A | A | G | T | T | A | T | G | A | T | C | G | N | N | A | G | A | A |
| A | 0.0 | 0.0 | 0.0 | 0.0 | 100.0 | 100.0 | 0.0 | 0.0 | 100.0 | 100.0 | 0.0 | 0.0 | 0.0 | 100.0 | 0.0 | 0.1 | 99.7 | 0.1 | 0.1 | 0.0 | 100.0 | 99.7 | 100.0 | 0.0 | 100.0 | 100.0 |
| C | 99.9 | 0.0 | 0.0 | 0.0 | 0.0 | 0.0 | 0.0 | 0.0 | 0.0 | 0.0 | 0.0 | 0.0 | 0.0 | 0.0 | 0.0 | 0.2 | 0.0 | 0.0 | 99.8 | 0.0 | 0.0 | 0.3 | 0.0 | 0.0 | 0.0 | 0.0 |
| G | 0.0 | 0.0 | 99.9 | 0.0 | 0.0 | 0.0 | 0.0 | 99.9 | 0.0 | 0.0 | 99.9 | 0.0 | 0.0 | 0.0 | 0.0 | 99.7 | 0.1 | 0.0 | 0.0 | 99.9 | 0.0 | 0.0 | 0.0 | 100.0 | 0.0 | 0.0 |
| T | 0.0 | 100.0 | 0.1 | 100.0 | 0.0 | 0.0 | 100.0 | 0.1 | 0.0 | 0.0 | 0.0 | 100.0 | 100.0 | 0.0 | 100.0 | 0.1 | 0.2 | 99.9 | 0.1 | 0.1 | 0.0 | 0.0 | 0.0 | 0.0 | 0.0 | 0.0 |

| | INDEL % |
|---|---|
| ABE-ST1 CAS9 | 0.07% |
| ST1-CAS9 NUCLEASE | 25.5% |
| UNTREATED | 0.04% |

FIG. 9B

ABE ST1-CAS9

| | P | A | M | 20 | 19 | 18 | 17 | 16 | 15 | 14 | 13 | 12 | 11 | 10 | 9 | 8 | 7 | 6 | 5 | 4 | 3 | 2 | 1 |
|---|---|---|---|---|---|---|---|---|---|---|---|---|---|---|---|---|---|---|---|---|---|---|---|
| | T | G | T | N | T | G | T | G | A | C | T | A | C | A | G | T | G | G | G | G | G | C |
| A | 0.0 | 0.0 | 0.0 | 0.0 | 0.0 | 0.0 | 0.0 | 0.0 | 0.0 | 0.0 | 0.0 | 7.7 | 0.0 | 100.0 | 100.0 | 0.0 | 0.0 | 0.0 | 0.0 | 0.0 | 0.0 | 0.0 | 0.0 |
| C | 0.0 | 0.0 | 0.0 | 0.0 | 0.0 | 0.0 | 0.0 | 0.0 | 0.0 | 100.0 | 0.0 | 0.0 | 100.0 | 0.0 | 0.0 | 0.0 | 5.9 | 0.0 | 0.0 | 0.0 | 0.0 | 0.0 | 100.0 |
| G | 0.0 | 100.0 | 0.0 | 0.0 | 0.0 | 100.0 | 0.0 | 100.0 | 0.0 | 0.0 | 0.0 | 0.0 | 0.0 | 0.0 | 0.0 | 100.0 | 0.0 | 99.9 | 100.0 | 100.0 | 100.0 | 100.0 | 0.0 |
| T | 100.0 | 0.0 | 100.0 | 100.0 | 100.0 | 0.0 | 100.0 | 0.0 | 0.0 | 0.0 | 100.0 | 92.3 | 0.0 | 0.0 | 0.0 | 0.0 | 94.1 | 0.1 | 0.0 | 0.0 | 0.0 | 0.0 | 0.0 |

UNTREATED

| | P | A | M | 20 | 19 | 18 | 17 | 16 | 15 | 14 | 13 | 12 | 11 | 10 | 9 | 8 | 7 | 6 | 5 | 4 | 3 | 2 | 1 |
|---|---|---|---|---|---|---|---|---|---|---|---|---|---|---|---|---|---|---|---|---|---|---|---|
| | T | G | T | N | T | G | T | G | A | C | T | A | C | A | G | T | G | G | G | G | G | C |
| A | 0.0 | 0.0 | 0.0 | 0.0 | 0.0 | 0.0 | 0.0 | 0.0 | 0.0 | 0.0 | 0.0 | 0.0 | 0.0 | 100.0 | 100.0 | 0.0 | 0.0 | 0.0 | 0.0 | 0.0 | 0.0 | 0.0 | 0.0 |
| C | 0.0 | 0.0 | 0.0 | 0.0 | 0.0 | 0.0 | 0.0 | 0.0 | 0.0 | 100.0 | 0.0 | 0.0 | 100.0 | 0.0 | 0.0 | 0.0 | 0.0 | 0.0 | 0.0 | 0.0 | 0.0 | 0.0 | 100.0 |
| G | 0.0 | 100.0 | 0.0 | 0.0 | 0.0 | 100.0 | 0.0 | 100.0 | 0.0 | 0.0 | 0.0 | 0.0 | 0.0 | 0.0 | 0.0 | 100.0 | 0.0 | 100.0 | 100.0 | 100.0 | 100.0 | 100.0 | 0.0 |
| T | 100.0 | 0.0 | 100.0 | 100.0 | 100.0 | 0.0 | 100.0 | 0.0 | 0.0 | 0.0 | 100.0 | 100.0 | 0.0 | 0.0 | 0.0 | 0.0 | 100.0 | 0.0 | 0.0 | 0.0 | 0.0 | 0.0 | 0.0 |

| | INDEL % |
|---|---|
| ABE-ST1 CAS9 | 0.16% |
| ST1-CAS9 NUCLEASE | 2.8% |
| UNTREATED | 0.12% |

| | | T | G | P | T | A | L | M | N | C | A | G | A | T | T | G | T | C | T | T | A | C | T | T | G | T | C |
|---|---|---|---|---|---|---|---|---|---|---|---|---|---|---|---|---|---|---|---|---|---|---|---|---|---|---|---|
| | | T | G | I | G | T | N | I | N | N | C | A | G | A | T | T | G | T | C | T | T | A | C | T | T | G | T | C |
| | | | | 21 | 20 | 19 | 18 | 17 | 16 | 15 | 14 | 13 | 12 | 11 | 10 | 9 | 8 | 7 | 6 | 5 | 4 | 3 | 2 | 1 |

ABE ST1-CAS9

| | | | | 21 | 20 | 19 | 18 | 17 | 16 | 15 | 14 | 13 | 12 | 11 | 10 | 9 | 8 | 7 | 6 | 5 | 4 | 3 | 2 | 1 |
|---|---|---|---|---|---|---|---|---|---|---|---|---|---|---|---|---|---|---|---|---|---|---|---|---|
| A | 0.0 | 0.0 | 0.0 | 0.0 | 0.0 | 0.0 | 0.0 | 100.0 | 0.0 | 0.0 | 0.0 | 0.0 | 0.0 | 0.0 | 0.0 | 0.0 | 100.0 | 0.0 | 0.0 | 0.0 | 0.0 | 0.0 | 0.0 |
| C | 0.0 | 0.0 | 0.0 | 0.0 | 0.0 | 0.0 | 0.0 | 0.0 | 0.0 | 0.1 | 0.3 | 0.0 | 0.7 | 100.0 | 0.5 | 0.4 | 4.2 | 0.0 | 100.0 | 0.4 | 0.2 | 0.0 | 0.2 | 99.9 |
| G | 99.9 | 0.0 | 99.9 | 0.0 | 100.0 | 99.9 | 0.0 | 0.0 | 99.9 | 0.0 | 0.0 | 99.9 | 0.0 | 0.0 | 0.0 | 0.0 | 0.0 | 0.0 | 0.0 | 0.0 | 0.0 | 100.0 | 0.0 | 0.0 |
| T | 0.0 | 100.0 | 0.0 | 100.0 | 0.0 | 0.0 | 100.0 | 0.0 | 99.9 | 99.9 | 99.7 | 0.0 | 99.3 | 0.0 | 99.5 | 99.6 | 95.8 | 0.0 | 0.0 | 99.6 | 99.8 | 0.0 | 99.8 | 0.0 |

UNTREATED

| | | | | 21 | 20 | 19 | 18 | 17 | 16 | 15 | 14 | 13 | 12 | 11 | 10 | 9 | 8 | 7 | 6 | 5 | 4 | 3 | 2 | 1 |
|---|---|---|---|---|---|---|---|---|---|---|---|---|---|---|---|---|---|---|---|---|---|---|---|---|
| A | 0.0 | 0.0 | 0.0 | 0.0 | 0.0 | 0.0 | 0.0 | 100.0 | 0.0 | 0.0 | 0.0 | 0.0 | 0.0 | 0.0 | 0.0 | 0.0 | 100.0 | 0.0 | 0.0 | 0.0 | 0.0 | 0.0 | 0.0 |
| C | 0.0 | 0.0 | 100.0 | 0.0 | 0.0 | 0.0 | 0.0 | 0.0 | 0.0 | 0.0 | 0.0 | 0.0 | 0.0 | 100.0 | 0.0 | 0.0 | 0.0 | 0.0 | 100.0 | 0.0 | 0.0 | 0.0 | 0.0 | 100.0 |
| G | 99.9 | 0.0 | 0.0 | 0.0 | 100.0 | 99.9 | 0.0 | 0.0 | 100.0 | 0.0 | 0.0 | 100.0 | 0.0 | 0.0 | 0.0 | 0.0 | 0.0 | 0.0 | 0.0 | 0.0 | 0.0 | 99.9 | 0.0 | 0.0 |
| T | 0.1 | 100.0 | 0.0 | 100.0 | 0.0 | 0.0 | 100.0 | 0.0 | 100.0 | 100.0 | 100.0 | 0.0 | 100.0 | 0.0 | 100.0 | 100.0 | 100.0 | 0.0 | 0.0 | 100.0 | 100.0 | 0.0 | 100.0 | 0.0 |

| | INDEL% |
|---|---|
| ABE-ST1 CAS9 | 0.10% |
| ST1-CAS9 NUCLEASE | 8.73% |
| UNTREATED | 0.08% |

FIG. 9E

A·T TO G·C MUTATION INDUCED BY ABE-ST1CAS9 AT SICKLE CELL DISEASE TARGET SITE!

| | INDEL% |
|---|---|
| ABE-ST1 CAS9 | 0.07% |
| ST1-CAS9 NUCLEASE | 2.30% |
| UNTREATED | 0.04% |

METHODS OF SUBSTITUTING PATHOGENIC AMINO ACIDS USING PROGRAMMABLE BASE EDITOR SYSTEMS

RELATED APPLICATIONS

This application is the U.S. national phase application, pursuant to 35 U.S.C. § 371, of PCT International Application No.: PCT/US2019/031897, filed May 11, 2019, designating the United States and published in English, which claims the benefit of U.S. Provisional Application No. 62/670,521, filed May 11, 2018, U.S. Provisional Application No. 62/670,539, filed May 11, 2018 and U.S. Provisional Application No. 62/780,890, filed Dec. 17, 2018, the entire contents of each of which are incorporated herein by reference in its entirety.

SEQUENCE LISTING

The instant application contains a Sequence Listing which has been submitted electronically in ASCII format and is hereby incorporated by reference in its entirety. Said ASCII copy, created on Feb. 20, 2024, is named 180802-040307US-Sequence_Listing.txt and is 654,947 bytes in size.

BACKGROUND OF THE DISCLOSURE

For most known genetic diseases, correction of a point mutation in the target locus, rather than stochastic disruption of the gene, is needed to study or address the underlying cause of the disease. Current genome editing technologies utilizing the clustered regularly interspaced short palindromic repeat (CRISPR) system introduce double-stranded DNA breaks at a target locus as the first step to gene correction. In response to double-stranded DNA breaks, cellular DNA repair processes mostly result in random insertions or deletions (indels) at the site of DNA cleavage through non-homologous end joining. Although most genetic diseases arise from point mutations, current approaches to point mutation correction are inefficient and typically induce an abundance of random insertions and deletions (indels) at the target locus resulting from the cellular response to dsDNA breaks. Therefore, there is a need for an improved form of genome editing that is more efficient and with far fewer undesired products such as stochastic insertions or deletions (indels) or translocations.

INCORPORATION BY REFERENCE

All publications, patents, and patent applications mentioned in this specification are herein incorporated by reference to the same extent as if each individual publication, patent, or patent application was specifically and individually indicated to be incorporated by reference. Absent any indication otherwise, publications, patents, and patent applications mentioned in this specification are incorporated herein by reference in their entireties.

SUMMARY OF THE DISCLOSURE

Provided herein is a method for treating a genetic disorder in a subject, in which the method comprises administering a base editor, or a polynucleotide encoding the base editor, to the subject, wherein the base editor comprises a polynucleotide-programmable nucleotide-binding domain and a deaminase domain; administering a guide polynucleotide to the subject, wherein the guide polynucleotide targets the base editor to a target nucleotide sequence of the subject; and editing a nucleobase of the target nucleotide sequence by deaminating the nucleobase upon targeting of the base editor to the target nucleotide sequence, thereby treating the genetic disorder by changing the nucleobase to another nucleobase; wherein the genetic disorder is caused by a pathogenic amino acid in a protein, and wherein another nucleobase substitutes the pathogenic amino acid with a benign amino acid that is different than a wild type amino acid of the protein.

Provided herein is a method of producing a cell, tissue, or organ for treating a genetic disorder in a subject, in which the method comprises contacting the cell, tissue, or organ with a base editor, or a polynucleotide encoding the base editor, wherein the base editor comprises a polynucleotide-programmable nucleotide-binding domain and a deaminase domain; contacting the cell, tissue, or organ with a guide polynucleotide, wherein the guide polynucleotide targets the base editor to a target nucleotide sequence of the cell, tissue, or organ; and editing a nucleobase of the target nucleotide sequence by deaminating the nucleobase upon targeting of the base editor to the target nucleotide sequence, thereby producing a cell, tissue, or organ for treating the genetic disorder by changing the nucleobase to another nucleobase; wherein the genetic disorder is caused by a pathogenic amino acid in a protein, and wherein another nucleobase substitutes the pathogenic amino acid with a benign amino acid that is different than a wild type amino acid of the protein. In some embodiments, the method further comprises administering the cell, tissue, or organ to the subject. In some embodiments, the cell, tissue, or organ is autologous to the subject. In some embodiments, the cell, tissue, or organ is allogeneic to the subject. In some embodiments, the cell, tissue, or organ is xenogeneic to the subject.

In some embodiments, the nucleobase is located in a gene that is the cause of the genetic disorder. In some embodiments, the editing comprises editing a plurality of nucleobases located in the gene, wherein the plurality of nucleobases is not the cause of the genetic disorder. In some embodiments, the editing further comprises editing one or more additional nucleobases located in at least one other gene. In some embodiments, the gene and the at least one other gene encode one or more subunits of the protein.

In some embodiments, the edited nucleobase is in a gene listed in Table 3A or 3B, and the editing results in an amino acid change in a protein encoded by the gene indicated in Table 3A or 3B. In some embodiments, the genetic disorder is ACADM deficiency, sickle cell disease (SCD), a hemoglobin disease, beta-thalassemia, Pendred syndrome, autosomal dominant Parkinson's disease, or alpha-1 antitrypsin deficiency (A1AD).

In an aspect, the present invention features compositions and methods for substituting pathogenic amino acids using a programmable nucleobase editor. In particular, compositions and methods are provided for base editing a thymidine (T) to a cytidine (C) nucleobase in the codon of the sixth amino acid of a sickle cell disease variant of the β-globin protein (Sickle HbS; E6V), thereby substituting an alanine for a valine (E6A). Substitution of alanine for valine at position 6 of Sickle HbS generates a β-globin protein variant that lacks a sickle cell phenotype (e.g., has properties of normal β-globin protein (HbA; E6) and does not have the potential to polymerize as in the case of the pathogenic variant HbS, etc.). Thus, the compositions and methods of the invention are useful for the treatment of sickle cell disease. In an embodiment, the edited nucleobase is in an HBB gene encoding beta (β)-globin, and the base editing results in an amino acid change from valine (Val) to alanine (Ala) at amino acid 6 in a β-globin (HBB) protein encoded by the HBB gene (β6Val→Ala). In certain embodiments, the genetic disorder is sickle cell disease or a hemoglobin disease. In some embodiments, the base editing results in an E6V>E6A amino acid change in a beta subunit of hemoglobin.

In another aspect, the invention provides a method of editing an HBB polynucleotide comprising a single nucleotide polymorphism (SNP) associated with sickle cell disease, in which the method comprises contacting the HBB polynucleotide with a base editor in complex with one or more guide polynucleotides, wherein the base editor comprises a polynucleotide programmable DNA binding domain and an adenosine deaminase domain, and wherein the one or more guide polynucleotides target the base editor to effect an A•T to G•C alteration of the SNP associated with sickle cell disease.

In another aspect, the invention provides a cell, which is produced by introducing into the cell, or a progenitor thereof, a base editor, a polynucleotide encoding the base editor, which comprises a polynucleotide programmable DNA binding domain and an adenosine deaminase domain; and one or more guide polynucleotides that target the base editor to effect an A•T to G•C alteration of the SNP associated with sickle cell disease.

In another aspect, the invention provides a method of treating sickle cell disease in a subject comprising administering to a subject in need thereof a cell according to any aspect delineated herein.

In another aspect, the invention provides an isolated cell or population of cells propagated or expanded from the cell according to any aspect delineated herein.

In another aspect, the invention provides a method of treating sickle cell disease in a subject in which the method comprises administering to a subject in need thereof a base editor, or a polynucleotide encoding the base editor, wherein the base editor comprises a polynucleotide programmable DNA binding domain and an adenosine deaminase domain; and one or more guide polynucleotides that target the base editor to effect an A•T to G•C alteration of the SNP associated with sickle cell disease.

In another aspect, the invention provides a method of producing a red blood cell (erythrocyte), or progenitor thereof, in which the method comprises (a) introducing into a red blood cell progenitor comprising an SNP associated with sickle cell disease, a base editor, or a polynucleotide encoding the base editor, wherein the base editor comprises a polynucleotide-programmable nucleotide-binding domain and an adenosine deaminase domain, and one or more guide polynucleotides; wherein the one or more guide polynucleotides target the base editor to effect an A•T to G•C alteration of the SNP associated with sickle cell disease; and (b) differentiating the red blood cell progenitor into an erythrocyte.

In another aspect, the invention provides a base editor comprising: (i) a polynucleotide programmable DNA binding domain comprising a *Streptococcus thermophilus* 1 Cas9 (St1Cas9), and (ii) an adenosine deaminase domain.

In another aspect, the invention provides a guide RNA (gRNA) comprising a nucleic acid sequence selected from CUUCUCCACAGGAGUCAGAU (SEQ ID NO: 5); ACUUCUCCACAGGAGUCAGAU (SEQ ID NO: 6); and GACUUCUCCACAGGAGUCAGAU (SEQ ID NO: 7).

In another aspect, the invention provides a base editor comprising: (i) a polynucleotide programmable DNA binding domain comprising a modified *Staphylococcus aureus* Cas9 (SaCas9), and (ii) an adenosine deaminase domain.

In another aspect, the invention provides a guide RNA (gRNA) comprising a nucleic acid sequence selected from UCCACAGGAGUCAGAUGCAC (SEQ ID NO: 8) and UCCACAGGAGUCAGAUGCAC (SEQ ID NO: 8).

In another aspect, the invention provides a guide RNA (gRNA) comprising a nucleic acid sequence selected from UUCUCCACAGGAGUCAGA (SEQ ID NO: 9); CUUCUCCACAGGAGUCAGA (SEQ ID NO: 10); ACUUCUCCACAGGAGUCAGA (SEQ ID NO: 11); GACUUCUCCACAGGAGUCAGA (SEQ ID NO: 12); and AGACUUCUCCACAGGAGUCAGA (SEQ ID NO: 13).

In an embodiment, the base editing results in an E342K>E342G amino acid change in the SERPINA1 gene-encoded alpha-1 antitrypsin protein. In an embodiment, the genetic disorder is Medium-chain acyl-CoA dehydrogenase (ACADM) deficiency. In an embodiment, the base editing results in a K329E>K329G amino acid change in the Medium-chain acyl-CoA dehydrogenase (ACADM) gene-encoded protein. In an embodiment, the genetic disorder is a hemoglobin disease. In an embodiment, the base editing results in an E26K>E26G amino acid change in a beta subunit of hemoglobin encoded by the HBB gene. In some embodiments, the genetic disorder is Pendred syndrome. In some embodiments, the base editing results in a T416P>T416F amino acid change in the SLC26A4; Solute Carrier Family 26 Member 4 (PDS) protein encoded by the PDS gene. In some embodiments, the genetic disorder is autosomal dominant Parkinson's disease. In some embodiments, the editing results in an A30P>A30L amino acid change in the alpha synuclein (SNCA) protein encoded by the SNCA gene.

In various embodiments of any aspect delineated herein, the A•T to G•C alteration at the SNP associated with sickle cell disease changes a valine to an alanine in the HBB polypeptide. In various embodiments, the SNP associated with sickle cell disease results in expression of an HBB polypeptide having a valine at amino acid position 6. In various embodiments, the SNP associated with sickle cell disease substitutes a glutamic acid with a valine.

In various embodiments of any aspect delineated herein, the contacting is in a cell, a eukaryotic cell, a mammalian cell, or human cell. In various embodiments, the subject is a mammal or a human. In various embodiments, the cell is in vivo or ex vivo. In various embodiments, the cell or progenitor thereof is an embryonic stem cell, induced pluripotent stem cell hematopoietic stem cell, a common myeloid progenitor, proerythroblast, erythroblast, reticulocyte, or erythrocyte. In various embodiments, the hematopoietic stem cell is a CD34$^+$ cell. In various embodiments, the cell is from a subject having sickle cell disease. In various embodiments, the cell is autologous to the subject. In various embodiments, the cell is allogeneic or xenogeneic to the subject. In various embodiments of any aspect delineated herein, the method comprises delivering the base editor, or polynucleotide encoding the base editor, and the one or more guide polynucleotides to a cell of the subject.

In various embodiments of any aspect delineated herein, the polynucleotide programmable DNA binding domain is a modified *Staphylococcus aureus* Cas9 (SaCas9), *Streptococcus thermophilus* 1 Cas9 (St1Cas9), a modified *Streptococcus pyogenes* Cas9 (SpCas9), or variants thereof. In various embodiments, the polynucleotide programmable DNA binding domain comprises a modified SaCas9 having an altered protospacer-adjacent motif (PAM) specificity. In various embodiments, the altered PAM comprises the nucleic acid sequence 5'-NNNRRT-3'. In various embodiments, the modified SaCas9 comprises amino acid substitutions E782K, N968K, and R1015H, or corresponding amino acid substitutions thereof.

In various embodiments, the polynucleotide programmable DNA binding domain comprises a variant of SpCas9 having an altered protospacer-adjacent motif (PAM) specificity. In various embodiments, the altered PAM comprises the nucleic acid sequence 5'-NGC-3'.

In various embodiments, the modified SpCas9 comprises amino acid substitutions D1135M, S1136Q, G1218K, E1219F, A1322R, D1332A, R1335E, and T1337R, or corresponding amino acid substitutions thereof. In various embodiments, the polynucleotide programmable DNA binding domain is a nuclease inactive or nickase variant. In various embodiments, the nickase variant comprises an amino acid substitution D10A or a corresponding amino acid substitution thereof.

In various embodiments of any aspect delineated herein, the base editor further comprises a zinc finger domain. In various embodiments, the zinc finger domain comprises recognition helix sequences RNEHLEV (SEQ ID NO: 14), QSTTLKR (SEQ ID NO: 15), and RTEHLAR (SEQ ID NO: 16) or recognition helix sequences RGEHLRQ (SEQ ID NO: 17), QSGTLKR (SEQ ID NO: 18), and RNDKLVP (SEQ ID NO: 19). In various, the zinc finger domain is one or more of zf1ra or zf1rb.

In various embodiments of any aspect delineated herein, the adenosine deaminase domain is capable of deaminating adenine in deoxyribonucleic acid (DNA). In various embodiments, the adenosine deaminase is a modified adenosine deaminase that does not occur in nature. In various embodiments, the adenosine deaminase is a TadA deaminase. In various embodiments, TadA deaminase is TadA*7.10.

In various embodiments of any aspect delineated herein, the one or more guide RNAs comprises a CRISPR RNA (crRNA) and a trans-encoded small RNA (tracrRNA), wherein the crRNA comprises a nucleic acid sequence complementary to an HBB nucleic acid sequence comprising the SNP associated with sickle cell disease. In various embodiments, the base editor is in complex with a single guide RNA (sgRNA) comprising a nucleic acid sequence complementary to an HBB nucleic acid sequence comprising the SNP associated with sickle cell disease.

In various embodiments of any aspect delineated herein, the St1Cas9 comprises the following amino acid sequence:

(SEQ ID NO: 20)
SDLVLGLAIGIGSVGVGILNKVTGEIIHKNSRIFPAAQAENNLVRRTNRQG

RRLARRKKHRRVRLNRLFEESGLITDFTKISINLNPYQLRVKGLTDELSNE

ELFIALKNMVKHRGISYLDDASDDGNSSVGDYAQIVKENSKQLETKTPGQI

QLERYQTYGQLRGDFTVEKDGKKHRLINVFPTSAYRSEALRILQTQQEFNP

QITDEFINRYLEILTGKRKYYHGPGNEKSRTDYGRYRTSGETLDNIFGILI

GKCTFYPDEFRAAKASYTAQEFNLLNDLNNLTVPTETKKLSKEQKNQIINY

VKNEKAMGPAKLFKYIAKLLSCDVADIKGYRIDKSGKAEIHTFEAYRKMKT

LETLDIEQMDRETLDKLAYVLTLNTEREGIQEALEHEFADGSFSQKQVDEL

VQFRKANSSIFGKGWHNFSVKLMMELIPELYETSEEQMTILTRLGKQKTTS

SSNKTKYIDEKLLTEEIYNPVVAKSVRQAIKIVNAAIKEYGDFDNIVIEMA

-continued
RETNEDDEKKAIQKIQKANKDEKDAAMLKAANQYNGKAELPHSVFHGHKQL

ATKIRLWHQQGERCLYTGKTISIHDLINNSNQFEVDHILPLSITFDDSLAN

KVLVYATANQEKGQRTPYQALDSMDDAWSFRELKAFVRESKTLSNKKKEYL

LTEEDISKEDVRKKFIERNLVDTLYASRVVLNALQEHFRAHKIDTKVSVVR

GQFTSQLRRHWGIEKTRDTYHHHAVDALIIAASSQLNLWKKQKNTLVSYSE

DQLLDIETGELISDDEYKESVFKAPYQHFVDTLKSKEFEDSILFSYQVDSK

FNRKISDATIYATRQAKVGKDKADETYVLGKIKDIYTQDGYDAFMKIYKKD

KSKFLMYRHDPQTFEKVIEPILENYPNKQINDKGKEVPCNPFLKYKEEHGY

IRKYSKKGNGPEIKSLKYYDSKLGNHIDITPKDSNNKVVLQSVSPWRADVY

FNKTTGKYEILGLKYADLQFDKGTGTYKISQEKYNDIKKKEGVDSDSEFKF

TLYKNDLLLVKDTETKEQQLFRFLSRTMPKQKHYVELKPYDKQKFEGGEAL

IKVLGNVANSGQCKKGLGKSNISIYKVRTDVLGNQHIIKNEGDKPKLDF.

In various embodiments, the base editor comprises a linker between the polynucleotide programmable DNA binding domain and the adenosine deaminase domain. In various embodiments, the linker comprises the amino acid sequence: SGGSSGGSSGSETPGTSESATPES (SEQ ID NO: 21). In various embodiments, the base editor comprises one or more nuclear localization signals. In various embodiments, the base editor comprises the following amino acid sequence:

(SEQ ID NO: 22)
MPKKKRKVSEVEFSHEYWMRHALTLAKRAWDEREVPVGAVLVHNNRVIGEG

WNRPIGRHDPTAHAEIMALRQGGLVMQNYRLIDATLYVTLEPCVMCAGAMI

HSRIGRVVFGARDAKTGAAGSLMDVLHHPGMNHRVEITEGILADECAALLS

DFFRMRRQEIKAQKKAQSSTDSGGSSGGSSGSETPGTSESATPESSGGSSG

GSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRMP

RQVFNAQKKAQSSTDSGGSSGGSSGSETPGTSESATPESDLVLGLAIGIGS

VGVGILNKVTGEIIHKNSRIFPAAQAENNLVRRTNRQGRRLARRKKHRRVR

LNRLFEESGLITDFTKISINLNPYQLRVKGLTDELSNEELFIALKNMVKHR

GISYLDDASDDGNSSVGDYAQIVKENSKQLETKTPGQIQLERYQTYGQLRG

DFTVEKDGKKHRLINVFPTSAYRSEALRILQTQQEFNPQITDEFINRYLEI

LTGKRKYYHGPGNEKSRTDYGRYRTSGETLDNIFGILIGKCTFYPDEFRAA

KASYTAQEFNLLNDLNNLTVPTETKKLSKEQKNQIINYVKNEKAMGPAKLF

KYIAKLLSCDVADIKGYRIDKSGKAEIHTFEAYRKMKTLETLDIEQMDRET

LDKLAYVLTLNTEREGIQEALEHEFADGSFSQKQVDELVQFRKANSSIFGK

GWHNFSVKLMMELIPELYETSEEQMTILTRLGKQKTTSSSNKTKYIDEKLL

TEEIYNPVVAKSVRQAIKIVNAAIKEYGDFDNIVIEMARETNEDDEKKAIQ

KIQKANKDEKDAAMLKAANQYNGKAELPHSVFHGHKQLATKIRLWHQQGER

CLYTGKTISIHDLINNSNQFEVDHILPLSITFDDSLANKVLVYATANQEKG

QRTPYQALDSMDDAWSFRELKAFVRESKTLSNKKKEYLLTEEDISKEDVRK

KFIERNLVDTLYASRVVLNALQEHFRAHKIDTKVSVVRGQFTSQLRRHWGI

EKTRDTYHHHAVDALIIAASSQLNLWKKQKNTLVSYSEDQLLDIETGELIS
DDEYKESVFKAPYQHFVDTLKSKEFEDSILFSYQVDSKFNRKISDATIYAT
RQAKVGKDKADETYVLGKIKDIYTQDGYDAFMKIYKKDKSKFLMYRHDPQT
FEKVIEPILENYPNKQINDKGKEVPCNPFLKYKEEHGYIRKYSKKGNGPEI
KSLKYYDSKLGNHIDITPKDSNNKVVLQSVSPWRADVYFNKTTGKYEILGL
KYADLQFDKGTGTYKISQEKYNDIKKKEGVDSDSEFKFTLYKNDLLLVKDT
ETKEQQLFRFLSRTMPKQKHYVELKPYDKQKFEGGEALIKVLGNVANSGQC
KKGLGKSNISIYKVRTDVLGNQHIIKNEGDKPKLDFPKKKRKVEGADKRTA
DGSEFESPKKKRKV.

In various embodiments of any aspect delineated herein, the guide RNA further comprises the nucleic acid sequence:

(SEQ ID NO: 23)
GUUUUUGUACUCUCAAGAUUUAAGUAACUGUACAACGAAACUUACACAGUU
ACUUAAAUCUUGCAGAAGCUACAAAGAUAAGGCUUCAUGCCGAAAUCAACA
CCCUGUCAUUUUAUGGCAGGGUG.

In various embodiments, the guide RNA comprises a nucleic acid sequence selected from (SEQ ID NO: 24)
CUUCUCCACAGGAGUCAGAUGUUUUUGUACUCUCAAGAUUUAAGUAACU
GUACAACGAAACUUACACAGUUACUUAAAUCUUGCAGAAGCUACAAAGA
UAAGGCUUCAUGCCGAAAUCAACACCCUGUCAUUUUAUGGCAGGGUG;

(SEQ ID NO: 25)
ACUUCUCCACAGGAGUCAGAUGUUUUUGUACUCUCAAGAUUUAAGUAAC
UGUACAACGAAACUUACACAGUUACUUAAAUCUUGCAGAAGCUACAAAG
AUAAGGCUUCAUGCCGAAAUCAACACCCUGUCAUUUUAUGGCAGGGUG;
or (SEQ ID NO: 26)
GACUUCUCCACAGGAGUCAGAUGUUUUUGUACUCUCAAGAUUUAAGUAA
CUGUACAACGAAACUUACACAGUUACUUAAAUCUUGCAGAAGCUACAAA
GAUAAGGCUUCAUGCCGAAAUCAACACCCUGUCAUUUUAUGGCAGGGUG.

In various embodiments of any aspect delineated herein, the protein nucleic acid complex comprises the base editor according to any aspect delineated herein and a guide RNA according to any aspect delineated herein.

In various embodiments of any aspect delineated herein, modified SaCas9 comprises amino acid substitutions E782K, N968K, and R1015H, or corresponding amino acid substitutions thereof. In various embodiments, the SaCas9 comprises the amino acid sequence:

(SEQ ID NO: 27)
KRNYILGLAIGITSVGYGIIDYETRDVIDAGVRLFKEANVENNEGRRSKRG
ARRLKRRRRHRIQRVKKLLFDYNLLTDHSELSGINPYEARVKGLSQKLSEE
EFSAALLHLAKRRGVHNVNEVEEDTGNELSTKEQISRNSKALEEKYVAELQ
LERLKKDGEVRGSINRFKTSDYVKEAKQLLKVQKAYHQLDQSFIDTYIDLL
ETRRTYYEGPGEGSPFGWKDIKEWYEMLMGHCTYFPEELRSVKYAYNADLY
NALNDLNNLVITRDENEKLEYYEKFQIIENVFKQKKKPTLKQIAKEILVNE
EDIKGYRVTSTGKPEFTNLKVYHDIKDITARKEIIENAELLDQIAKILTIY
QSSEDIQEELTNLNSELTQEEIEQISNLKGYTGTHNLSLKAINLILDELWH
TNDNQIAIFNRLKLVPKKVDLSQQKEIPTTLVDDFILSPVVKRSFIQSIKV
INAIIKKYGLPNDIIIELAREKNSKDAQKMINEMQKRNRQTNERIEEIIRT
TGKENAKYLIEKIKLHDMQEGKCLYSLEAIPLEDLLNNPFNYEVDHIIPRS
VSFDNSFNNKVLVKQEENSKKGNRTPFQYLSSSDSKISYETFKKHILNLAK
GKGRISKTKKEYLLEERDINRFSVQKDFINRNLVDTRYATRGLMNLLRSYF
RVNNLDVKVKSINGGFTSFLRRKWKFKKERNKGYKHHAEDALIIANADFIF
KEWKKLDKAKKVMENQMFEEKQAESMPEIETEQEYKEIFITPHQIKHIKDF
KDYKYSHRVDKKPNRKLINDTLYSTRKDDKGNTLIVNNLNGLYDKDNDKLK
KLINKSPEKLLMYHHDPQTYQKLKLIMEQYGDEKNPLYKYYEETGNYLTKY
SKKDNGPVIKKIKYYGNKLNAHLDITDDYPNSRNKVVKLSLKPYRFDVYLD
NGVYKFVTVKNLDVIKKENYYEVNSKCYEEAKKLKKISNQAEFIASFYKND
LIKINGELYRVIGVNNDLLNRIEVNMIDITYREYLENMNDKRPPHIIKTIA
SKTQSIKKYSTDILGNLYEVKSKKHPQIIKKG.

In various embodiments of any aspect delineated herein, the base editor comprises the amino acid sequence:

(SEQ ID NO: 28)
MSEVEFSHEYWMRHALTLAKRAWDEREVPVGAVLVHNNRVIGEGWNRPIGR
HDPTAHAEIMALRQGGLVMQNYRLIDATLYVTLEPCVMCAGAMIHSRIGRV
VFGARDAKTGAAGSLMDVLHHPGMNHRVEITEGILADECAALLSDFFRMRR
QEIKAQKKAQSSTDSGGSSGGSSGSETPGTSESATPESSGGSSGGSSEVEF
SHEYWMRHALTLAKRARDEREVPVGAVLVLNNRVIGEGWNRAIGLHDPTAH
AEIMALRQGGLVMQNYRLIDATLYVTFEPCVMCAGAMIHSRIGRVVFGVRN
AKTGAAGSLMDVLHYPGMNHRVEITEGILADECAALLCYFFRMPRQVFNAQ
KKAQSSTDSGGSSGGSSGSETPGTSESATPESSGGSSGGSKRNYILGLAIG
ITSVGYGIIDYETRDVIDAGVRLFKEANVENNEGRRSKRGARRLKRRRRHR
IQRVKKLLFDYNLLTDHSELSGINPYEARVKGLSQKLSEEEFSAALLHLAK
RRGVHNVNEVEEDTGNELSTKEQISRNSKALEEKYVAELQLERLKKDGEVR
GSINRFKTSDYVKEAKQLLKVQKAYHQLDQSFIDTYIDLLETRRTYYEGPG
EGSPFGWKDIKEWYEMLMGHCTYFPEELRSVKYAYNADLYNALNDLNNLVI
TRDENEKLEYYEKFQIIENVFKQKKKPTLKQIAKEILVNEEDIKGYRVTST
GKPEFTNLKVYHDIKDITARKEIIENAELLDQIAKILTIYQSSEDIQEELT
NLNSELTQEEIEQISNLKGYTGTHNLSLKAINLILDELWHTNDNQIAIFNR
LKLVPKKVDLSQQKEIPTTLVDDFILSPVVKRSFIQSIKVINAIIKKYGLP
NDIIIELAREKNSKDAQKMINEMQKRNRQTNERIEEIIRTTGKENAKYLIE
KIKLHDMQEGKCLYSLEAIPLEDLLNNPFNYEVDHIIPRSVSEDNSENNKV
LVKQEENSKKGNRTPFQYLSSSDSKISYETFKKHILNLAKGKGRISKTKKE
YLLEERDINRFSVQKDFINRNLVDTRYATRGLMNLLRSYFRVNNLDVKVKS

-continued
INGGFTSFLRRKWKFKKERNKGYKHHAEDALIIANADFIFKEWKKLDKAKK
VMENQMFEEKQAESMPEIETEQEYKEIFITPHQIKHIKDFKDYKYSHRVDK
KPNRKLINDTLYSTRKDDKGNTLIVNNLNGLYDKDNDKLKKLINKSPEKLL
MYHHDPQTYQKLKLIMEQYGDEKNPLYKYYEETGNYLTKYSKKDNGPVIKK
IKYYGNKLNAHLDITDDYPNSRNKVVKLSLKPYREDVYLDNGVYKEVTVKN
LDVIKKENYYEVNSKCYEEAKKLKKISNQAEFIASFYKNDLIKINGELYRV
IGVNNDLLNRIEVNMIDITYREYLENMNDKRPPHIIKTIASKTQSIKKYST
DILGNLYEVKSKKHPQIIKKGEGADKRTADGSEFESPKKKRKV.

In various embodiments, the base editor comprises the amino acid sequence:

(SEQ ID NO: 29)
MSEVEFSHEYWMRHALTLAKRAWDEREVPVGAVLVHNNRVIGEGWNRPIGR
HDPTAHAEIMALRQGGLVMQNYRLIDATLYVTLEPCVMCAGAMIHSRIGRV
VFGARDAKTGAAGSLMDVLHHPGMNHRVEITEGILADECAALLSDFFRMRR
QEIKAQKKAQSSTDSGGSSGGSSGSETPGTSESATPESSGGSSGGSSEVEF
SHEYWMRHALTLAKRARDEREVPVGAVLVLNNRVIGEGWNRAIGLHDPTAH
AEIMALRQGGLVMQNYRLIDATLYVTFEPCVMCAGAMIHSRIGRVVFGVRN
AKTGAAGSLMDVLHYPGMNHRVEITEGILADECAALLCYFFRMPRQVFNAQ
KKAQSSTDSGGSSGGSSGSETPGTSESATPESSGGSSGGSKRNYILGLAIG
ITSVGYGIIDYETRDVIDAGVRLFKEANVENNEGRRSKRGARRLKRRRRHR
IQRVKKLLFDYNLLTDHSELSGINPYEARVKGLSQKLSEEEFSAALLHLAK
RRGVHNVNEVEEDTGNELSTKEQISRNSKALEEKYVAELQLERLKKDGEVR
GSINRFKTSDYVKEAKQLLKVQKAYHQLDQSFIDTYIDLLETRRTYYEGPG
EGSPFGWKDIKEWYEMLMGHCTYFPEELRSVKYAYNADLYNALNDLNNLVI
TRDENEKLEYYEKFQIIENVFKQKKKPTLKQIAKEILVNEEDIKGYRVTST
GKPEFTNLKVYHDIKDITARKEIIENAELLDQIAKILTIYQSSEDIQEELT
NLNSELTQEEIEQISNLKGYTGTHNLSLKAINLILDELWHTNDNQIAIFNR
LKLVPKKVDLSQQKEIPTTLVDDFILSPVVKRSFIQSIKVINAIIKKYGLP
NDIIIELAREKNSKDAQKMINEMQKRNRQTNERIEEIIRTTGKENAKYLIE
KIKLHDMQEGKCLYSLEAIPLEDLLNNPFNYEVDHIIPRSVSFDNSFNNKV
LVKQEENSKKGNRTPFQYLSSSDSKISYETFKKHILNLAKGKGRISKTKKE
YLLEERDINRFSVQKDFINRNLVDTRYATRGLMNLLRSYFRVNNLDVKVKS
INGGFTSFLRRKWKFKKERNKGYKHHAEDALIIANADFIFKEWKKLDKAKK
VMENQMFEEKQAESMPEIETEQEYKEIFITPHQIKHIKDFKDYKYSHRVDK
KPNRKLINDTLYSTRKDDKGNTLIVNNLNGLYDKDNDKLKKLINKSPEKLL
MYHHDPQTYQKLKLIMEQYGDEKNPLYKYYEETGNYLTKYSKKDNGPVIKK
IKYYGNKLNAHLDITDDYPNSRNKVVKLSLKPYRFDVYLDNGVYKFVTVKN
LDVIKKENYYEVNSKCYEEAKKLKKISNQAEFIASFYKNDLIKINGELYRV
IGVNNDLLNRIEVNMIDITYREYLENNINDKRPPHIIKTIASKTQSIKKYS
TDILGNLYEVKSKKHPQIIKKGEGADKRTADGSEFESPKKKRKVSSGNSNA
NSRGPSFSSGLVPLSLRGSHSRPGERPFQCRICMRNFSRNEHLEVHTRTHT
GEKPFQCRICMRNFSQSTTLKRHLRTHTGEKPFQCRICMRNFSRTEHLARH
LKTHLRGSSAQ;
or (SEQ ID NO: 30)
MSEVEFSHEYWMRHALTLAKRAWDEREVPVGAVLVHNNRVIGEGWNRPIGR
HDPTAHAEIMALRQGGLVMQNYRLIDATLYVTLEPCVMCAGAMIHSRIGRV
VFGARDAKTGAAGSLMDVLHHPGMNHRVEITEGILADECAALLSDFFRMRR
QEIKAQKKAQSSTDSGGSSGGSSGSETPGTSESATPESSGGSSGGSSEVEF
SHEYWMRHALTLAKRARDEREVPVGAVLVLNNRVIGEGWNRAIGLHDPTAH
AEIMALRQGGLVMQNYRLIDATLYVTFEPCVMCAGAMIHSRIGRVVFGVRN
AKTGAAGSLMDVLHYPGMNHRVEITEGILADECAALLCYFFRMPRQVFNAQ
KKAQSSTDSGGSSGGSSGSETPGTSESATPESSGGSSGGSKRNYILGLAIG
ITSVGYGIIDYETRDVIDAGVRLFKEANVENNEGRRSKRGARRLKRRRRHR
IQRVKKLLFDYNLLTDHSELSGINPYEARVKGLSQKLSEEEFSAALLHLAK
RRGVHNVNEVEEDTGNELSTKEQISRNSKALEEKYVAELQLERLKKDGEVR
GSINRFKTSDYVKEAKQLLKVQKAYHQLDQSFIDTYIDLLETRRTYYEGPG
EGSPFGWKDIKEWYEMLMGHCTYFPEELRSVKYAYNADLYNALNDLNNLVI
TRDENEKLEYYEKFQIIENVFKQKKKPTLKQIAKEILVNEEDIKGYRVTST
GKPEFTNLKVYHDIKDITARKEIIENAELLDQIAKILTIYQSSEDIQEELT
NLNSELTQEEIEQISNLKGYTGTHNLSLKAINLILDELWHTNDNQIAIFNR
LKLVPKKVDLSQQKEIPTTLVDDFILSPVVKRSFIQSIKVINAIIKKYGLP
NDIIIELAREKNSKDAQKMINEMQKRNRQTNERIEEIIRTTGKENAKYLIE
KIKLHDMQEGKCLYSLEAIPLEDLLNNPFNYEVDHIIPRSVSFDNSFNNKV
LVKQEENSKKGNRTPFQYLSSSDSKISYETFKKHILNLAKGKGRISKTKKE
YLLEERDINRFSVQKDFINRNLVDTRYATRGLMNLLRSYFRVNNLDVKVKS
INGGFTSFLRRKWKFKKERNKGYKHHAEDALIIANADFIFKEWKKLDKAKK
VMENQMFEEKQAESMPEIETEQEYKEIFITPHQIKHIKDFKDYKYSHRVDK
KPNRKLINDTLYSTRKDDKGNTLIVNNLNGLYDKDNDKLKKLINKSPEKLL
MYHHDPQTYQKLKLIIVIEQYGDEKNPLYKYYEETGNYLTKYSKKDNGPVI
KKIKYYGNKLNAHLDITDDYPNSRNKVVKLSLKPYRFDVYLDNGVYKFVTV
KNLDVIKKENYYEVNSKCYEEAKKLKKISNQAEFIASFYKNDLIKINGELY
RVIGVNNDLLNRIEVNMIDITYREYLENMNDKRPPHIIKTIASKTQSIKKY
STDILGNLYEVKSKKHPQIIKKGEGADKRTADGSEFESPKKKRKVSSGNSN
ANSRGPSFSSGLVPLSLRGSHSRPGERPFQCRICMRNFSRGEHLRQHTRTH
TGEKPFQCRICMRNFSQSGTLKRHLRTHTGEKPFQCRICMRNFSRNDKLVP
HLKTHLRGSSAQ.

In various embodiments of any aspect delineated herein, the guide RNA further comprises the nucleic acid sequence (SEQ ID NO: 31)
GUUUUAGUACUCUGUAAUGAAAAUUACAGAAUCUACUAAAACAAGGCAAAA
UGCCGUGUUUAUCUCGUCAACUUGUUGGCGAGAUUUUUU.

In various embodiments, the guide RNA comprises the nucleic acid sequence UCCACAGGAGUCAGAUGCACGUUUUAGUACUCU-GUAAUGAAAAUUACAGAAUCU ACUAAAACAAGGCAAAAUGCCGUGUUUAUCUC-GUCAACUUGUUGGCGAGAUUUU UU (SEQ ID NO: 32), or the nucleic acid sequence CUCCACAGGAGUCAGAUGCACGUUUUAGUACUCU-GUAAUGAAAAUUACAGAAUC UAC-UAAAACAAGGCAAAAUGCCGUGUUUAUCUCG-UCAACUUGUUGGCGAGAUUU UUU (SEQ ID NO: 33).

In some embodiments, any of the methods provided herein further comprise a second editing of an additional nucleobase. In an embodiment, the additional nucleobase is not the cause of the genetic disorder. In another embodiment, the additional nucleobase is the cause of the genetic disorder.

In another aspect, a method of treating a genetic disorder in a subject is provided in which the method comprises administering a base editor to a subject in need thereof, wherein the base editor comprises a polynucleotide-programmable nucleotide-binding domain and a deaminase domain in conjunction with a guide polynucleotide; binding of the guide polynucleotide to a target nucleotide sequence of a polynucleotide of the subject; and editing a nucleobase of the target nucleotide sequence by deaminating the nucleobase upon binding of the guide polynucleotide to the target nucleotide sequence, thereby treating the genetic disorder by changing the nucleobase to another nucleobase; wherein the nucleobase is in a regulatory element or regulatory region of a gene.

In another aspect, a method of producing a cell, tissue, or organ for treating a genetic disorder in a subject in need thereof is provided, in which the method comprises contacting the cell, tissue, or organ with a base editor, wherein the base editor comprises a polynucleotide-programmable nucleotide-binding domain and a deaminase domain in conjunction with a guide polynucleotide; binding of the guide polynucleotide to a target nucleotide sequence of a polynucleotide of the cell, tissue, or organ; and editing a nucleobase of the target nucleotide sequence by deaminating the nucleobase upon the binding of the guide polynucleotide to the target nucleotide sequence, thereby producing the cell, tissue, or organ for treating the genetic disorder by changing the nucleobase to another nucleobase; wherein the nucleobase is in a regulatory element of a gene. In some embodiments, the method further comprises administering the cell, tissue, or organ to the subject. In some embodiments, the cell, tissue, or organ is autologous to subject. In some embodiments, the cell, tissue, or organ is allogeneic to the subject. In some embodiments, the cell, tissue, or organ is xenogeneic to the subject.

In some embodiments of the above-delineated methods, the gene is the cause of the genetic disorder. In some embodiments, the gene is not the cause of the genetic disorder. In some embodiments, the editing results in a change in an amount of transcription of the gene. In some embodiments, the change is an increase in the amount of transcription of the gene. In some embodiments, the change is a decrease in the amount of transcription of the gene. In some embodiments, the editing alters a binding pattern of at least one protein to the regulatory element. In some embodiments, the regulatory element is a promoter, an enhancer, a repressor, a silencer, an insulator, a start codon, a stop codon, Kozak consensus sequence, a splice acceptor, a splice donor, a splice site, a 3' untranslated region (UTR), a 5' untranslated region (UTR), or an intergenic region of the gene. In some embodiments, the editing results in removal of a splice site. In some embodiments, the editing results in addition of a splice site. In some embodiments, the editing results in an intron inclusion. In some embodiments, the editing results in an exon skipping. In some embodiments, the editing results in removal of a start codon, stop codon, or Kozak consensus sequence. In some embodiments, the editing results in addition of a start codon, stop codon, or Kozak consensus sequence. In some embodiments, the editing comprises editing a plurality of nucleobases located in the regulatory element of the gene.

In some embodiments of the above-delineated methods, the editing comprises editing a plurality of nucleobases, wherein at least one nucleobase of the plurality of nucleobases is located in at least one additional regulatory element of at least one additional gene. In some embodiments, the gene and the at least one additional gene encode one or more subunits of at least one protein.

In some embodiments of the above-delineated methods, the editing is selected from any one of the changes as shown in Table 4 herein. In some embodiments, the genetic disorder is sickle cell disease (SCD), also termed sickle cell anemia. In some embodiments, the genetic disorder is Hereditary Persistence of Fetal Hemoglobin (HPFH). In some embodiments, the nucleobase is located in c. −114~−102 of HBG1/2. In some embodiments, the nucleobase is located in a promoter of HBG1/2.

In some embodiments of the above-delineated methods, the method comprises a second editing of at least one additional nucleobase, wherein the at least one additional nucleobase is not in the regulatory element of the gene. In some embodiments, the additional nucleobase is located in a protein coding region.

In certain embodiments of the methods of the above-delineated aspects, the deaminase domain is an adenosine deaminase domain. In some embodiments, the deaminase domain is a cytidine deaminase domain. In some embodiments, the adenosine deaminase domain is capable of deaminating adenine in deoxyribonucleic acid (DNA). In some embodiments, the guide polynucleotide comprises ribonucleic acid (RNA), or deoxyribonucleic acid (DNA). In some embodiments, the guide polynucleotide comprises a CRISPR RNA (crRNA) sequence, a trans-activating CRISPR RNA (tracrRNA) sequence, or a combination thereof.

In some embodiments, any of methods provided herein further comprises a second guide polynucleotide. In some embodiments, the second guide polynucleotide comprises ribonucleic acid (RNA), or deoxyribonucleic acid (DNA). In some embodiments, the second guide polynucleotide comprises a CRISPR RNA (crRNA) sequence, a trans-activating CRISPR RNA (tracrRNA) sequence, or a combination thereof. In some embodiments, the second guide polynucleotide targets the base editor to a second target nucleotide sequence.

In some embodiments, the polynucleotide-programmable DNA-binding domain comprises a Cas9 domain, a Cpf1 domain, a CasX domain, a CasY domain, a Cas12b/C2c1 domain, or a Cas12c/C2c3 domain. In some embodiments, the polynucleotide-programmable DNA-binding domain is nuclease dead. In some embodiments, the polynucleotide-programmable DNA-binding domain is a nickase. In some embodiments, the polynucleotide-programmable DNA-binding domain comprises a Cas9 domain. In some embodiments, the Cas9 domain comprises a nuclease dead Cas9 (dCas9), a Cas9 nickase (nCas9), or a nuclease active Cas9. In some embodiments, the Cas9 domain comprises a Cas9 nickase. In some embodiments, the polynucleotide-programmable DNA-binding domain is an engineered or a modified polynucleotide-programmable DNA-binding domain.

In some embodiments, any of the methods provided herein further comprises a second base editor. In some embodiments, the second base editor comprises a deaminase domain that is different from that of the other base editor.

In some embodiments, the base editing results in less than 20% indel formation. In some embodiments, the base editing results in less than 15% indel formation. In some embodiments, the base editing results in less than 10% indel formation. In some embodiments, the base editing results in less than 5% indel formation. In some embodiments, the base editing results in less than 4% indel formation. In some embodiments, the base editing results in less than 3% indel formation. In some embodiments, the base editing results in less than 2% indel formation. In some embodiments, the base editing results in less than 1% indel formation. In some embodiments, the base editing results in less than 0.5% indel formation. In some embodiments, the base editing results in less than 0.1% indel formation. In some embodiments, the base editing does not result in translocations.

BRIEF DESCRIPTION OF THE DRAWINGS

The features of the present disclosure are set forth with particularity in the appended claims. A better understanding of the features and advantages of the disclosure will be obtained by reference to the following detailed description that sets forth illustrative embodiments, in which the principles of the disclosure are described and utilized, and the accompanying drawings of which:

FIG. 3 discloses SEQ ID NOS 248 and 249, respectively, in order of appearance.

FIG. 6 presents a table showing the first 8 amino acids of mature hemoglobin (Hb), including normal HbA, pathogenic variants Sickle HbS and HbC, and the HbG Makassar variant, which is phenotypically like HbA and does not polymerize like HbS. Shown in FIG. 6 are the amino acids encoded at amino acid position 6 in each of the Hb types, as well as the DNA and mRNA sequences that encode the first 8 amino acids of these Hb proteins. FIG. 6 discloses SEQ ID NOS 268-277 and 66-67, respectively, in order of appearance.

FIGS. 7A and 7B depict the results of experiments to edit the nucleobase adenosine (A) to a guanosine (G) in the sequence (CAC) complementary to the codon encoding valine at amino acid position 6 of HbS using a variety of A-to-G base editors (ABEs) that recognize different PAM sequences. FIG. 7A is a table describing features of the HBB gRNAs and corresponding ABEs tested, including positions of the desired edit and potential off-target edits. FIG. 7A discloses SEQ ID NOS 250-253, respectively, in order of appearance. FIG. 7B is a graph showing the results of using the ABEs for base editing at the sickle cell target site. FIG. 7B discloses SEQ ID NO: 254.

FIG. 8A presents schematic depictions of the ABE constructs showing the organization of the domains within the polypeptides, including saKKH ABE7.10, saKKH ABE7.10 zf1ra, and saKKH ABE7.10 zf1rb. FIG. 8B shows the nucleic acid sequence at the sickle cell target site, as well as the target complementary sequence of the guide RNAs as depicted by the lines underneath (designated g1 and g4). FIG. 8B discloses SEQ ID NOS 255-257, respectively, in order of appearance. FIG. 8C is a graph depicting the results using saKKH ABE7.10, saKKH ABE7.10 zf1ra, and saKKH ABE7.10 zf1rb in combination with the guide RNA g1 having a nucleic acid sequence of 20 nucleotides (nt) in length, which is complementary to the sickle cell target site. To the right of the FIG. 8C graph is the nucleic acid sequence at the sickle cell target site and target complementary sequence of the g1 guide RNAs. FIG. 8C discloses SEQ ID NOS 255-257, respectively, in order of appearance. FIG. 8D is a graph depicting the results using saKKH ABE7.10, saKKH ABE7.10 zf1ra, and saKKH ABE7.10 zf1rb in combination with the guide RNA g1 having a nucleic acid sequence of 21 nt in length, which is complementary to the sickle cell target site. FIG. 8E is a graph depicting the results using saKKH ABE7.10, saKKH ABE7.10 zf1ra, and saKKH ABE7.10 zf1rb in combination with the guide RNA g4 having a nucleic acid sequence of 20 nt in length, which is complementary to the sickle cell target site. To the right of the FIG. 8E graph is the nucleic acid sequence at the sickle cell target site and target complementary sequence of the g4 guide RNAs. FIG. 8F is a graph depicting the results using saKKH ABE7.10, saKKH ABE7.10 zf1ra, and saKKH ABE7.10 zf1rb in combination with the guide RNA g4 having a nucleic acid sequence of 21 nt in length, which is complementary to the sickle cell target site. FIG. 8G depicts base editing at a control HEK2 site.

FIGS. 9A-9E depict the development and evaluation of an adenosine base editor (ABE) having a *Streptococcus thermophilus* Cas9 (St1Cas9) DNA binding domain for base editing at the sickle cell target site. FIG. 9A shows base editing using ABE St1Cas9 with the St1Cas9 canonical PAM sequence, NNAGAA (TTCTAG; reverse complement). The inset below shows indel percentages (Indel %) comparing ABE St1Cas9, St1Cas9 nuclease, and untreated at the base edited site. FIG. 9A discloses SEQ ID NO: 258. FIG. 9B shows base editing using ABE St1Cas9 with the St1Cas9 canonical PAM sequence NNAGAA. The inset below shows indel percentages comparing ABE St1Cas9, St1Cas9 nuclease, and untreated at the base edited site. FIG. 9B discloses SEQ ID NO: 259. FIG. 9C shows base editing using ABE St1Cas9 with the St1Cas9 non-canonical PAM sequence, NNACCA (TGGTNN; reverse complement). The inset below shows indel percentages comparing ABE St1Cas9, St1Cas9 nuclease, and untreated at the base edited site. FIG. 9C discloses SEQ ID NO: 260. FIG. 9D shows base editing using ABE St1Cas9 with the St1Cas9 non-canonical PAM sequence, NNACCA (TGGTNN; reverse complement). The inset below shows indel percentages comparing ABE St1Cas9, St1Cas9 nuclease, and untreated at the base edited site. FIG. 9D discloses SEQ ID NO: 261. FIG. 9E depicts base editing using the ABE St1Cas9 with the St1Cas9 non-canonical PAM sequence, NNACCA, at the sickle cell target site. The arrow indicates an A•T to G•C mutation (Val→Ala) was induced by the ABE-St1Cas9 base editor at the sickle cell target site in Hb. FIG. 9E discloses SEQ ID NOS 262 and 263, respectively, in order of appearance.

FIG. 10 discloses SEQ ID NOS 264 and 265, respectively, in order of appearance.

FIG. 11 discloses SEQ ID NO: 266.

DETAILED DESCRIPTION OF THE DISCLOSURE

Figure 1:
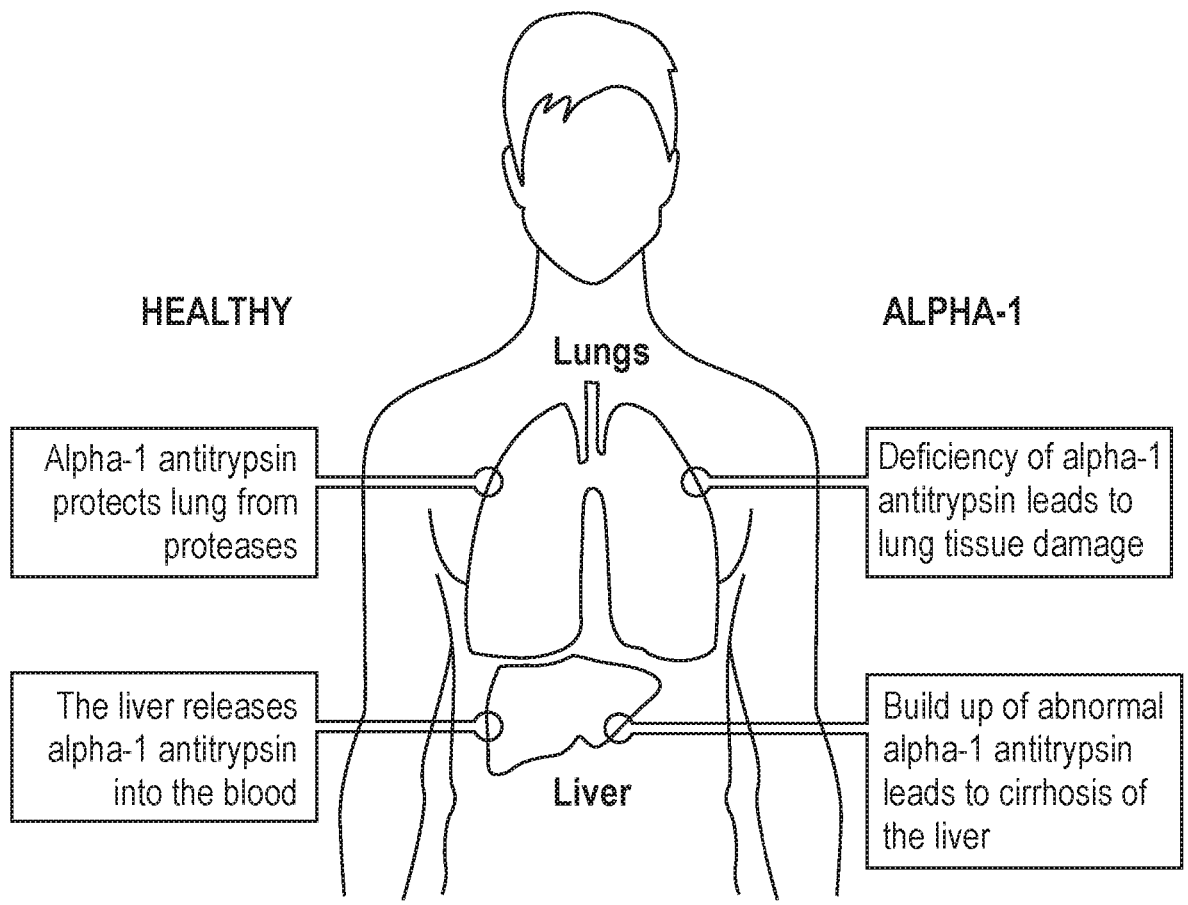
FIG. 1 is schematic diagram comparing a healthy subject and a patient with antitrypsin deficiency (A1AD). In a healthy subject, alpha-1 antitrypsin (A1AT) protein protects lung from proteases, and the liver releases alpha-1 antitrypsin into the blood. In a patient with alpha-1 antitrypsin deficiency (A1AD), a deficiency of normal alpha-1 antitrypsin leads to lung tissue damage. An accumulation of abnormal alpha-1 antitrypsin in hepatocytes in the liver leads to cirrhosis.

As described herein, the present invention features compositions and methods for substituting pathogenic amino acids using a programmable nucleobase editor. In a particular aspect, the described compositions and methods are useful for the treatment of sickle cell disease, which is caused by a Glu→Val mutation at the sixth amino acid of the β-globin protein encoded by the HBB gene. Despite many developments to date in the field of gene editing, precise correction of the diseased HBB gene to revert Val→Glu remains elusive, and has yet to be achieved using either CRISPR/Cas nuclease or CRISPR/Cas base editing approaches.

Genome editing of the HBB gene to replace the affected nucleotide using a CRISPR/Cas nuclease approach requires cleavage of genomic DNA. However, cleavage of genomic DNA carries an increased risk of generating base insertions/deletions (indels), which have the potential to cause unintended and undesirable consequences, including generating premature stop codons, altering the codon reading frame, etc. Furthermore, generating double-stranded breaks at the β-globin locus has the potential to radically alter the locus through recombination events. The β-globin locus contains a cluster of globin genes (–5'-ε-; Gγ-; Aγ-; δ-; and β-globin-3'), which have sequence identity to one another. Because of the structure of the β-globin locus, recombination repair of a double-stranded break within the locus has the potential to result in gene loss of intervening sequences between globin genes, for example between the δ- and β-globin genes. Unintended alterations to the locus also carry a risk of causing thalassemia.

CRISPR/Cas base editing approaches hold promise in that they have the ability to generate precise alterations at the nucleobase level. However, precise correction of Val→Glu (GTG→GAG) requires a T•A to A•T transversion editor, which is not presently known to exist. Additionally, the specificity of CRISPR/Cas base editing is due, in part, to a limited window of editable nucleotides created by R-loop formation upon CRISPR/Cas binding to DNA. Thus, CRISPR/Cas targeting must occur at or near the sickle cell site to allow base editing to be possible, and there may be additional sequence requirements for optimal editing within the window.

One requirement for CRISPR/Cas targeting is the presence of a protospacer-adjacent motif (PAM) sequence flanking the site to be targeted. For example, many base editors are based on SpCas9, which requires the PAM sequence NGG. Even assuming hypothetically that an T•A to A•T transversion were possible, no NGG PAM exists that would place the target "A" at a desirable position for such an SpCas9 base editor. Although many new CRISPR/Cas proteins have been discovered or generated that expand the collection of available PAMs, PAM requirements remain a limiting factor in the ability to direct CRISPR/Cas base editors to specific nucleotides at any location in the genome.

The present invention is based, at least in part, on several discoveries described herein that address the foregoing challenges for providing a genome editing approach for treatment of sickle cell anemia. In one aspect, the invention is based in part on the ability to replace the valine at amino acid position 6 of the Hb protein, which causes sickle cell disease, with an alanine, to thereby generate an Hb variant (Hb Makassar) that does not generate a sickle cell phenotype. While precise correction (GTG→GAG) is not possible without a T•A to A•T transversion base editor, the results described herein demonstrate the finding that a Val→Ala (GTG→GCG) replacement (i.e., the Hb Makassar variant) can be generated using an A•T to G•C base editor (ABE). This was achieved in part by the development of novel base editors and novel base editing strategies, as provided herein. For example, novel ABE base editors (i.e., having an adenosine deaminase domain) that utilize flanking sequences (e.g., PAM sequences; zinc finger binding sequences) for optimal base editing at the sickle cell target site were developed.

Provided and described herein are compositions and methods for base editing a thymidine (T) to a cytidine (C) in the codon of the sixth amino acid of a sickle cell disease variant of the β-globin protein (Sickle HbS; E6V), thereby substituting an alanine amino acid residue for a valine amino acid residue (V6A) at this amino acid position. Substitution of alanine for valine at position 6 of HbS generates a β-globin protein variant that does not have a sickle cell phenotype (e.g., does not have the potential to polymerize as in the case of the pathogenic variant HbS). Accordingly, the compositions and methods of the invention are useful for the treatment of sickle cell disease.

Provided and described herein are compositions and methods comprising the base editors and base editor systems as described herein for treating a disease or disorder caused by or associated with a gene provided in Tables 3A, 3B, or 4 herein.

The following description and examples illustrate embodiments of the present disclosure in detail. It is to be understood that this disclosure is not limited to the particular embodiments described herein and as such can vary. Those of skill in the art will recognize that there are numerous variations and modifications of this disclosure, which are encompassed within its scope.

All terms are intended to be understood as they would be understood by a person skilled in the art. Unless defined otherwise, all technical and scientific terms used herein have the same meaning as would be commonly understood by one of ordinary skill in the art to which the disclosure pertains.

The section headings used herein are for organizational purposes only and are not to be construed as limiting the subject matter described.

Although various features of the present disclosure can be described in the context of a single embodiment, the features can also be provided separately or in any suitable combination. Conversely, although the present disclosure can be described herein in the context of separate embodiments for clarity, the present disclosure can also be implemented in a single embodiment.

Definitions

Unless defined otherwise, all technical and scientific terms as used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991).

In this application, the use of the singular includes the plural unless specifically stated otherwise. It is noted that, as used in the specification, the singular forms "a," "an" and "the" include plural referents unless the context clearly dictates otherwise. In this application, the use of "or" means "and/or" unless stated otherwise. Furthermore, use of the term "including" as well as other forms, such as "include", "includes," and "included," is not limiting.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps. It is contemplated that any embodiment discussed in this specification can be implemented with respect to any method or composition of the present disclosure, and vice versa. Furthermore, compositions of the present disclosure can be used to achieve methods of the present disclosure.

The term "about" or "approximately" means within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, preferably within 5-fold, and more preferably within 2-fold, of a value. Where particular values are described in the application and claims, unless otherwise stated the term "about" meaning within an acceptable error range for the particular value should be assumed.

Reference in the specification to "some embodiments," "an embodiment," "one embodiment" or "other embodiments" means that a particular feature, structure, or characteristic described in connection with the embodiments is included in at least some embodiments, but not necessarily all embodiments, of the present disclosures.

By "adenosine deaminase" is meant a polypeptide or fragment thereof capable of catalyzing the hydrolytic deamination of adenine or adenosine. In some embodiments, the deaminase or deaminase domain is an adenosine deaminase catalyzing the hydrolytic deamination of adenosine to inosine or deoxy adenosine to deoxyinosine. In some embodiments, the adenosine deaminase catalyzes the hydrolytic deamination of adenine or adenosine in deoxyribonucleic acid (DNA). The adenosine deaminases (e.g. engineered adenosine deaminases, evolved adenosine deaminases) provided herein may be from any organism, such as a bacterium.

"Administering" is referred to herein as providing one or more products or compositions described herein to a patient or a subject. By way of example and without limitation, product or composition administration, e.g., injection, can be performed by intravenous (i.v.) injection, subcutaneous (s.c.) injection, intradermal (i.d.) injection, intraperitoneal (i.p.) injection, or intramuscular (i.m.) injection. One or more such routes can be employed. Parenteral administration can be, for example, by bolus injection or by gradual perfusion over time. Alternatively, or concurrently, administration can be by an oral route. Other modes of administration are also envisioned, such as, without limitation, intranasal, rectal, intracranial, intravaginal, buccal, thoracic, intradermal, transdermal, and the like.

By "agent" is meant any small molecule chemical compound, antibody, nucleic acid molecule, or polypeptide, or fragments thereof.

By "ameliorate" is meant decrease, suppress, attenuate, diminish, arrest, or stabilize the development or progression of a disease.

By "alteration" is meant a change (increase or decrease) in the expression levels or activity of a gene or polypeptide as detected by standard art known methods such as those described herein. As used herein, an alteration includes a 10% change in expression levels, preferably a 25% change, more preferably a 40% change, and most preferably a 50% or greater change in expression levels.

By "analog" is meant a molecule that is not identical, but has analogous functional or structural features. For example, a polypeptide analog retains the biological activity of a corresponding naturally-occurring polypeptide, while having certain biochemical modifications that enhance the analog's function relative to a naturally occurring polypeptide. Such biochemical modifications could increase the analog's protease resistance, membrane permeability, or half-life, without altering, for example, ligand binding. An analog may include an unnatural amino acid.

By "base editor (BE)," or "nucleobase editor (NBE)" is meant an agent that binds a polynucleotide and has nucleobase modifying activity. In various embodiments, the base editor comprises a nucleobase modifying polypeptide (e.g., a deaminase) and a polynucleotide programmable nucleotide binding domain in conjunction with a guide polynucleotide (e.g., guide RNA). In various embodiments, the agent is a biomolecular complex comprising a protein domain having base editing activity, i.e., a domain capable of modifying a base (e.g., A, T, C, G, or U) within a nucleic acid molecule (e.g., DNA). In some embodiments, the polynucleotide programmable DNA binding domain is fused or linked to a deaminase domain. In one embodiment, the agent is a fusion protein comprising a domain having base editing activity. In another embodiment, the protein domain having base editing activity is linked to the guide RNA (e.g., via an RNA binding motif on the guide RNA and an RNA binding domain fused to the deaminase). In some embodiments, the domain having base editing activity is capable of deaminating a base within a nucleic acid molecule. In some embodiments, the base editor is capable of deaminating a base within a DNA molecule. In some embodiments, the base editor is capable of deaminating a cytosine (C) or an adenosine (A) within DNA. In some embodiments, the base editor is a cytidine base editor (CBE). In some embodiments, the base editor is an adenosine base editor (ABE). In some embodiments, an adenosine deaminase is evolved from TadA. In some embodiments, the polynucleotide programmable DNA binding domain is a CRISPR associated (e.g., Cas or Cpf1) enzyme. In some embodiments, the base editor is a catalytically dead Cas9 (dCas9) fused to a deaminase domain. In some embodiments, the base editor is a Cas9 nickase (nCas9) fused to a deaminase domain. In some embodiments, the base editor is fused to an inhibitor of base excision repair (BER). In some embodiments, the inhibitor of base excision repair is a uracil DNA glycosylase inhibitor (UGI). In some embodiments, the inhibitor of base excision repair is an inosine base excision repair inhibitor. Details of base editors are described in International PCT Application Nos. PCT/2017/045381 (WO 2018/027078) and PCT/US2016/058344 (WO 2017/070632), each of which is incorporated herein by reference for its entirety. Also see, Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

By "cytidine deaminase" is meant a polypeptide or fragment thereof capable of catalyzing a deamination reaction that converts an amino group to a carbonyl group. In one embodiment, the cytidine deaminase converts cytosine to uracil or 5-methylcytosine to thymine. PmCDA1, which is derived from *Petromyzon marinus* (*Petromyzon marinus* cytosine deaminase 1, "PmCDA1"), AID (Activation-induced cytidine deaminase; AICDA), which is derived from a mammal (e.g., human, swine, bovine, horse, monkey etc.), and APOBEC are exemplary cytidine deaminases.

By way of example, the cytidine base editor BE4 has the following nucleic acid sequence. Polynucleotide sequences having at least 95% or greater identity to the BE4 nucleic acid sequence are also encompassed.

```
                                        (SEQ ID NO: 34)
ATGagctcagagactggcccagtggctgtggaccccacattgagacggcgg atcgagccccatgagtttgaggtattcttcgatccgagagagctccgcaag gagacctgcctgctttacgaaattaattggggggccggcactccatttgg cgacatacatcacagaacactaacaagcacgtcgaagtcaacttcatcgag aagttcacgacagaaagatatttctgtccgaacacaaggtgcagcattacc tggtttctcagctggagcccatgcggcgaatgtagtagggccatcactgaa ttcctgtcaaggtatcccacgtcactctgttatttacatcgcaaggctg taccaccacgctgacccccgcaatcgacaaggcctgcgggatttgatctct tcaggtgtgactatccaaattatgactgagcaggagtcaggatactgctgg agaaactttgtgaattatagcccgagtaatgaagcccactggcctaggtat ccccatctgtgggtacgactgtacgttcttgaactgtactgcatcatactg
```

-continued ggcctgcctccttgtctcaacattctgagaaggaagcagccacagctgaca
ttctttaccatcgctcttcagtcttgtcattaccagcgactgccccacac
attctctgggccaccgggttgaaatctggtggttcttctggtggttctagc
ggcagcgagactcccgggacctcagagtccgccacacccgaaagttctggt
ggttcttctggtggttctgataaaaagtattctattggtttagccatcggc
actaattccgttggatgggctgtcataaccgatgaatacaaagtaccttca
aagaaatttaaggtgttgggaacacagaccgtcattcgattaaaaagaat
cttatcggtgccctcctattcgatagtggcgaaacggcagaggcgactcgc
ctgaaacgaaccgctcggagaaggtatacacgtcgcaagaaccgaatatgt
tacttacaagaaattttagcaatgagatggccaaagttgacgattattat
tcaccgtttggaagagtccttccttgtcgaagaggacaagaaacatgaacg
gcacccatctttggaaacatagtagatgaggtggcatatcatgaaaagta
cccaacgattatcacctcagaaaaaagctagttgactcaactgataaagc
ggacctgaggttaatctacttggctcttgcccatatgataaagttccgtgg
gcactttctcattgagggtgatctaaatccggacaactcggatgtcgacaa
actgttcatccagttagtacaaacctataatcagttgtttgaagagaaccc
tataaatgcaagtggcgtggatgcgaaggctattcttagcgcccgcctctc
taaatcccgacggctagaaaacctgatcgcacaattcccggagagaagaa
aaatgggttgttcggtaaccttatagcgctctcactaggcctgacaccaaa
ttttaagtcgaacttcgacttagctgaagatgccaaattgcagcttagtaa
ggacacgtacgatgacgatctcgacaatctactggcacaaattggagatca
gtatgcggacttatttttggctgccaaaaaccttagcgatgcaatcctcct
atctgacatactgagagttaatactgagattaccaaggcgccgttatccgc
ttcaatgatcaaaaggtacgatgaacatcaccaagacttgacacttctcaa
ggccctagtccgtcagcaactgcctgagaaatataaggaaatattctttga
tcagtcgaaaaacgggtacgcaggttatattgacggcggagcgagtcaaga
ggaattctacaagtttatcaaacccatattagagaagatggatgggacgga
agagttgcttgtaaaactcaatcgcgaagatctactgcgaaagcagcggac
tttcgacaacggtagcattccacatcaaatccacttaggcgaattgcatgc
tatacttagaaggcaggaggattttttatccgttcctcaaagacaatcgtga
aaagattgagaaaatcctaaccttcgcataccttactatgtgggacccct
ggcccgagggaactctcggttcgcatggatgacaagaaagtccgaagaaac
gattactccatggaattttgaggaagttgtcgataaaggtgcgtcagctca
atcgttcatcgagaggatgaccaactttgacaagaatttaccgaacgaaaa
agtattgcctaagcacagtttactttacgagtatttcacagtgtacaatga
actcacgaaagttaagtatgtcactgagggcatgcgtaaacccgcctttct
aagcggagaacagaagaaagcaatagtagatctgttattcaagaccaaccg
caaagtgacagttaagcaattgaaagaggactactttaagaaaattgaatg
cttcgattctgtcgagatctccggggtagaagatcgatttaatgcgtcact
tggtacgtatcatgacctcctaaagataataaagatataaggacttcctgga
taacgaagagaatgaagatatcttagaagatatagtgttgactcttaccct -continued cttttgaagatcgggaaatgattgaggaaagactaaaaacatacgctcacct
gttcgacgataaggttatgaaacagttaaagaggcgtcgctatacgggctg
gggacgattgtcgcggaaacttatcaacgggataagagacaagcaaagtgg
taaaactattctcgattttctaaagagcgacggcttcgccaataggaactt
tatgcagctgatccatgatgactcttaaccttcaaagaggatatacaaaa
ggcacaggtttccggacaaggggactcattgcacgaacatattgcgaatct
tgctggttcgccagccatcaaaaagggcatactccagacagtcaaagtagt
ggatgagctagttaaggtcatgggacgtcacaaaccggaaaacattgtaat
cgagatggcacgcgaaaatcaaacgactcagaaggggcaaaaaaacagtcg
agagcggatgaagagaatagaagagggtattaaagaactgggcagccagat
cttaaaggagcatcctgtggaaaatacccaattgcagaacgagaaacttta
cctctattacctacaaaatggaagggacatgtatgttgatcaggaactgga
cataaaccgtttatctgattacgacgtcgatcacattgtaccccaatcctt
tttgaaggacgattcaatcgacaataaagtgcttacacgctcggataagaa
ccgagggaaaagtgacaatgttccaagcgaggaagtcgtaaagaaaatgaa
gaactattggcggcagctcctaaatgcgaaactgataacgcaaagaaagtt
cgataacttaactaaagctgagaggggtggcttgtctgaacttgacaaggc
cggattattaaacgtcagctcgtggaaacccgccaaatcacaaagcatgt
tgcacagatactagattcccgaatgaatacgaaatacgacgagaacgataa
gctgattcgggaagtcaaagtaatcacttttaaagtcaaaattggtgtcgga
cttcagaaaggattttcaattctataaagttagggagataaataactacca
ccatgcgcacgacgcttatcttaatgccgtcgtagggaccgcactcattaa
gaaatacccgaagctagaaagtgagtttgtgtatggtgattacaaagttta
tgacgtccgtaagatgatcgcgaaaagcgaacaggagataggcaaggctac
agccaaatacttcttttattctaacattatgaatttcttttaagacgaaat
cactctggcaaacggagagatacgcaaacgacctttaattgaaaccaatgg
ggagacaggtgaaatcgtatgggataagggccgggacttcgcgacggtgag
aaaagttttgtccatgccccaagtcaacatagtaaagaaaactgaggtgca
gaccggagggttttcaaaggaatcgattcttccaaaaaggaatagtgataa
gctcatcgctcgtaaaaaggactgggacccgaaaaagtacggtggcttcga
tagcccacagttgcctattctgtcctagtagtggcaaaagttgagaaggg
aaaatccaagaaactgaagtcagtcaaagaattattggggataacgattat
ggagcgctcgtcttttgaaaagaaccccatcgacttccttgaggcgaaagg
ttacaaggaagtaaaaaaggatctcataattaaactaccaaagtatagtct
gtttgagttagaaaatggccgaaaacggatgttggctagcgccggagagct
tcaaaaggggaacgaactcgcactaccgtctaaatacgtgaatttcctgta
tttagcgtcccattacgagaagttgaaaggttcacctgaagataacgaaca
gaagcaacttttttgttgagcagcacaaacattatctcgacgaaatcataga
gcaaatttcggaattcagtaagagagtcatcctagctgatgccaatctgga
caaagtattaagcgcatacaacaagcacagggataaaccccatacgtgagca

```
ggcggaaaatattatccattgtttactcttaccaacctcggcgctccagc
cgcattcaagtattttgacacaacgatagatcgcaaacgatacacttctac
caaggaggtgctagacgcgacactgattcaccaatccatcacgggattata
tgaaactcggatagatttgtcacagcttgggggtgactctggtggttctgg
aggatctggtggttctactaatctgtcagatattattgaaaaggagaccgg
taagcaactggttatccaggaatccatcctcatgctcccagaggaggtgga
agaagtcattgggaacaagccggaaagcgatatactcgtgcacaccgccta
cgacgagagcaccgacgagaatgtcatgcttctgactagcgacgcccctga
atacaagccttgggctctggtcatacaggatagcaacggtgagaacaagat
taagatgctctctggtggttctggaggatctggtggttctactaatctgtc
agatattattgaaaaggagaccggtaagcaactggttatccaggaatccat
cctcatgctcccagaggaggtggaagaagtcattgggaacaagccggaaag
cgatatactcgtgcacaccgcctacgacgagagcaccgacgagaatgtcat
gcttctgactagcgacgcccctgaatacaagccttgggctctggtcataca
ggatagcaacggtgagaacaagattaagatgctctctggtggttctaaaag
gacggcggacggatcagagttcgagagtccgaaaaaaaaacgaaaggtcga
ataa
```

A codon-optimized BE4 nucleic acid sequence is provided below:

(SEQ ID NO: 35)
```
atgtcatccgaaaccgggccagtggccgtagacccaacactcaggaggcgg
atagaaccccatgagtttgaagtgttcttcgaccccagagagctgcgcaaa
gagacttgcctcctgtatgaaataaattgggggggtcgccattcaatttgg
aggcacactagccagaatactaacaaacacgtggaggtaaattttatcgag
aagtttaccaccgaaagatacttttgccccaatacacggtgttcaattacc
tggtttctgtcatggagtccatgtggagaatgtagtagagcgataactgag
ttcctgtctcgatatcctcacgtcacgttgtttatatacatcgctcggctt
tatcaccatgcggacccgcggaacaggcaaggtcttcgggacctcatatcc
tctgggtgaccatccagataatgacggagcaagagagcggatactgctgg
cgaaactttgttaactacagcccaagcaatgaggcacactggcctagatat
ccgcatctctgggttcgactgtatgtccttgaactgtactgcataattctg
ggacttccgccatgcttgaacattctgcggcgaaacaaccacagctgacc
tttttcacgattgctctccaaagttgtcactaccagcgattgccaccccac
atcttgtgggctactggactcaagtctggaggaagttcaggcggaagcagc
gggtctgaaacgcccggaacctcagagagcgcaacgcccgaaagctctgga
gggtcaagtggtggtagtgataagaaatactccatcggcctcgccatcggt
acgaattctgtcggttgggccgttatcaccgatgagtacaaggtcccttct
aagaaattcaaggttttgggcaatacagaccgccattctataaaaaaaaac
ctgatcggcgcccttttgtttgacagtggtgagactgctgaagcgactcgc
ctgaagcgaactgccaggaggcggtatacgaggcgaaaaaaccgaatttgt
tacctccaggagattttctcaaatgaaatggccaaggtagatgatagttt
tttcaccgcttggaagaaagttttctcgttgaggaggacaaaaagcacgag
aggcacccaatctttggcaacatagtcgatgaggtcgcataccatgagaaa
tatcctacgatctatcatctccgcaagaagctggtcgatagcacggataaa
gctgacctccggctgatctaccttgctcttgctcacatgattaaattcagg
ggccatttcctgatagaaggagacctcaatcccgacaattctgatgtcgac
aaactgtttattcagctcgttcagacctataatcaactctttgaggagaac
cccatcaatgcttcaggggtggacgcaaaggccatttttgtccgcgcgcttg
agtaaatcacgacgcctcgagaatttgatagctcaactgccgggtgagaag
aaaaacgggttgtttgggaatctcatagcgttgagtttgggacttacgcca
aactttaagtctaactttgatttggccgaagatgccaaattgcagctgtcc
aaagatacctatgatgacgacttggataaccttcttgcgcagattggtgac
caatacgcggatctgtttcttgccgcaaaaaatctgtccgacgccatactc
ttgtccgatatactgcgcgtcaatactgagataactaaggctcccctcagc
gcgtccatgattaaaagatacgatgagcaccaccaagatctcactctgttg
aaagccctggttcgccagcagcttccagagaagtataaggagatattttc
gaccaatctaaaaacggctatgcgggttacattgacggtggcgcctctcaa
gaagaattctacaagtttataaagccgatacttgagaaaatggacggtaca
gaggaattgttggttaagctcaatcgcgaggacttgttgagaaagcagcgc
acatttgacaatggtagtattccacaccagattcatctgggcgagttgcat
gccattcttagaagacaagaagattttatccgtttctgaaagataacaga
gaaaagattgaaaagatacttacctttcgcataccgtattatgtaggtccc
ctggctagagggaacagtcgcttcgcttggatgactcgaaaatcagaagaa
acaataaccccctggaattttgaagaagtggtagataaaggtgcgagtgcc
caatcttttattgagcggatgacaaattttgacaagaatctgcctaacgaa
aaggtgcttcccaagcattccctttttgtatgaatactttacagtatataat
gaactgactaaagtgaagtacgttaccgaggggatgcgaaagccagctttt
ctcagtggcgagcagaaaaaagcaatagttgacctgctgttcaagacgaat
aggaaggttaccgtcaaacagctcaaagaagattactttaaaaagatcgaa
tgttttgattcagttgagataagcggagtagaggatagatttaacgcaagt
cttggaacttatcatgaccttttgaagatcatcaaggataaagattttttg
gacaacgaggagaatgaagatatcctggaagatatagtacttaccttgacg
cttttttgaagatcgagagatgatcgaggagcgacttaagacgtacgcacat
ctctttgacgataaggttatgaaacaattgaaacgccgcggtatactggc
tggggcaggctttctcgaaagctgattaatggtatccgcgataagcagtct
ggaaagacaatccttgactttctgaaaagtgatggatttgcaaatagaaac
tttatgcagcttatacatgatgactcttttgacgttcaaggaagacatccag
aaggcacaggtatccggccaaggggatagcctccatgaacacatagccaac
ctggccggctcaccagctattaaaaagggaatattgcaaaccgttaaggtt
gttgacgaactcgttaaggttatgggccgacacaaaccagagaatatcgtg
attgagatggctagggagaatcagaccactcaaaaaggtcagaaaaattct
``` cgcgaaaggatgaagcgaattgaagagggaatcaaagaacttggctctcaa
attttgaaagagcacccggtagaaaacactcagctgcagaatgaaaagctg
tatctgtattatctgcagaatggtcgagatatgtacgttgatcaggagctg
gatatcaataggctcagtgactacgatgtcgaccacatcgttcctcaatct
ttcctgaaagatgactctatcgacaacaaagtgttgacgcgatcagataag
aaccggggaaaatccgacaatgtaccctcagaagaagttgtcaagaagatg
aaaaactattggagacaattgctgaacgccaagctcataacacaacgcaag
ttcgataacttgacgaaagccgaaagaggtgggttgtcagaattggacaaa
gctggctttattaagcgccaattggtggagacccggcagattacgaaacac
gtagcacaaattttggattcacgaatgaataccaaatacgacgaaaacgac
aaattgatacgcgaggtgaaagtgattacgcttaagagtaagttggtttcc
gatttcaggaaggattttcagttttacaaagtaagagaaataaacaactac
caccacgccatgatgcttacctcaacgcggtagttggcacagctcttatc
aaaaaatatccaaagctggaaagcgagttcgtttacggtgactataaagta
tacgacgttcggaagatgatagccaaatcagagcaggaaattgggaaggca
accgcaaaatacttcttctattcaaacatcatgaacttctttaagacggag
attacgctcgcgaacggcgaaatacgaagaggcccctcatagagactaac
ggcgaaaccggggagatcgtatgggacaaaggacgggactttgcgaccgtt
agaaaagtactttcaatgccacaagtgaatattgttaaaaagacagaagta
caaacaggggggttcagtaaggaatccatttttgcccaagcggaacagtgat
aaattgatagcaaggaaaaagattgggaccctaagaagtacggtggtttc
gactctcctaccgttgcatattcagtccttgtagttgcgaaagtggaaaag
gggaaaagtaagaagcttaagagtgttaaagagcttctgggcataaccata
atggaacggtctagcttcgagaaaaatccaattgactttctcgaggctaaa
ggttacaaggaggtaaaaaaggacctgataattaaactcccaaagtacagt
ctcttcgagttggagaatgggaggaagagaatgttggcatctgcaggggag
ctccaaaaggggaacgagctggctctgccttcaaaatacgtgaactttctg
tacctggccagccactacgagaaactcaagggttctcctgaggataacgag
cagaaacagctgtttgtagagcagcacaagcattacctggacgagataatt
gagcaaattagtgagttctcaaaaagagtaatccttgcagacgcgaatctg
gataaagttcttttccgcctataataagcaccgggacaagcctatacgagaa
caagccgagaacatcattcacctcttttacccttactaatctgggcgcgccg
gccgccttcaaatacttcgacaccacgatagacaggaaaaggtatacgagt
accaaagaagtacttgacgccactctcatccaccagtctataacagggttg
tacgaaacgaggatagatttgtcccagctcggcggcgactcaggagggtca
ggcggctccggtggatcaacgaatcttccgacataatcgagaagaaacc
ggcaaacagttggtgatccaagaatcaatcctgatgctgcctgaagaagta
gaagaggtgattggcaacaaacctgagtctgacattcttgtccacaccgcg
tatgacgagagcacggacgagaacgttatgcttctcactagcgacgccct
gagtataaaccatgggcgctggtcatccaagattccaatggggaaaacaag
attaagatgcttagtggtgggtctggagggagcggtgggtccacgaacctc agcgacattattgaaaagagactggtaaacaacttgtaatacaagagtct
attctgatgttgcctgaagaggtggaggaggtgattgggaacaaaccggag
tctgatatacttgttcataccgcctatgacgaatctactgatgagaatgtg
atgcttttaacgtcagacgctcccgagtacaaaccctgggctctggtgatt
caggacagcaatggtgagaataagattaaaatgttgagtgggggctcaaag
cgcacggctgacggtagcgaatttgagagccccaaaaaaaaacgaaaggtc
gaataa Another codon optimized BE4 nucleic acid sequence (GeneArt, ThermoFisher Scientific) is provided below:

(SEQ ID NO: 36)
atgagcagcgagacaggccctgtggctgtggatcctacactgcggagaaga
atcgagccccacgagttcgaggtgttcttcgaccccagagagctgcggaaa
gagacatgcctgctgtacgagatcaactggggcggcagacactctatctgg
cggcacacaagccagaacaccaacaagcacgtggaagtgaactttatcgag
aagtttacgaccgagcggtacttctgccccaacaccagatgcagcatcacc
tggtttctgagctggtcccttgcggcgagtgcagcagagccatcaccgag
tttctgtccagatatccccacgtgaccctgttcatctatatcgcccggctg
taccaccacgccgatcctagaaatagacagggactgcgcgacctgatcagc
agcggagtgaccatccagatcatgaccgagcaagagagcggctactgctgg
cggaacttcgtgaactacagccccagcaacgaagcccactggcctagatat
cctcacctgtgggtccgactgtacgtgctggaactgtactgcatcatcctg
ggcctgcctccatgcctgaacatcctgagaagaaagcagcctcagctgacc
ttcttcacaatcgccctgcagagctgccactaccagagactgcctccacac
atcctgtgggccaccggacttaagagcggaggatctagcggcggctctagc
ggatctgagacacctggcacaagcgagtctgccacacctgagagtagcggc
ggatcttctggcggctccgacaagaagtactctatcggactggccatcggc
accaactctgttggatgggccgtgatcaccgacgagtacaaggtgcccagc
aagaaattcaaggtgctgggcaacaccgaccggcacagcatcaagaagaat
ctgatcggcgccctgctgttcgactctggcgaaacagccgaagccaccaga
ctgaagagaaccgccaggcggagatacacccggcggaagaaccggatctgc
tacctgcaagatctttcagcaacgagatggccaaggtggacgacagcttc
ttccacagactggaagagtccttcctggtggaagaggacaagaagcacgag
cggcacccatcttcggcaacatcgtggatgaggtggcctaccacgagaag
tacccaccatctaccacctgagaaagaaactggtggacagcaccgacaag
gccgacctgagactgatctacctggctctggcccacatgatcaagttccgg
ggccactttctgatcgagggcgatctgaaccccgacaacagcgacgtggac
aagctgttcatccagctggtgcagacctacaaccagctgttcgaggaaaac
cccatcaacgcctctggcgtggacgccaaggctatcctgtctgccagactg
agcaagagcagaaggctgaaaaacctgatcgcccagctgcctggcgagaag
aagaatggcctgttcggcaaccctgattgccctgagcctgggactgaccccct -continued

```
aacttcaagagcaacttcgacctggccgaggatgccaaactgcagctgagc
aaggacacctacgacgacgacctggacaatctgctggcccagatcggcgat
cagtacgccgacttgtttctggccgccaagaacctgtccgacgccatcctg
ctgagcgatatcctgagagtgaacaccgagatcacaaaggcccctctgagc
gcctctatgatcaagagatacgacgagcaccaccaggatctgaccctgctg
aaggccctcgttagacagcagctgccagagaagtacaaagagattttcttc
gatcagtccaagaacggctacgccggctacattgatggcggagccagccaa
gaggaattctacaagttcatcaagcccatcctggaaaagatggacggcacc
gaggaactgctggtcaagctgaacagagaggacctgctgcggaagcagcgg
accttcgacaatggctctatccctcaccagatccacctgggagagctgcac
gccattctgcggagacaagaggactttttacccattcctgaaggacaaccgg
gaaaagatcgaagatcctgaccttcaggatcccctactacgtgggacca
ctggccagaggcaatagcagattcgcctgatgaccagaaagagcgaggaa
accatcacaccctggaacttcgaggaagtggtggacaagggcgccagcgct
cagtccttcatcgagcggatgaccaacttcgataagaacctgcctaacgag
aaggtgctgcccaagcactccctgctgtatgagtacttcaccgtgtacaac
gagctgaccaaagtgaaatacgtgaccgagggaatgagaaagcccgccttt
ctgagcggcgagcagaaaaaggccattgtggatctgctgttcaagaccaac
cggaaagtgaccgtgaagcagctgaaagaggactacttcaagaaaatcgag
tgcttcgacagcgtggaaatcagcggcgtggaagatcggttcaatgccagc
ctgggcacataccacgacctgctgaaaattatcaaggacaaggacttcctg
gacaacgaagagaacgaggacattctcgaggacatcgtgctgaccctgaca
ctgtttgaggacagagagatgatcgaggaacggctgaaaacatacgccac
ctgttcgacgacaaagtgatgaagcaactgaagcggaggcggtacacaggc
tggggcagactgtctcggaagctgatcaacggcatccgggataagcagtcc
ggcaagacaatcctggatttcctgaagtccgacggcttcgccaacagaaac
ttcatgcagctgatccacgacgacagcctgacctttaaagaggacatccag
aaagcccaggtgtccggccaaggcgattctctgcacgagcacattgccaac
ctggccggatctcccgccattaagaagggcatcctgcagacagtgaaggtg
gtggacgagcttgtgaaagtgatgggcagacacaagcccgagaacatcgtg
atcgaaatggccagagagaaccagaccacacagaagggccagaagaacagc
cgcgagagaatgaagcggatcgaagagggcatcaaagagctgggcagccag
atcctgaaagaacacccgtggaaaacacccagctgcagaacgagaagctg
tacctgtactacctgcagaatggacgggatatgtacgtggaccaagagctg
gacatcaaccggctgagcgactacgatgtggaccatatcgtgccccagagc
tttctgaaggacgactccatcgataacaaggtcctgaccagaagcgacaag
aaccggggcaagagcgataacgtgccctccgaagaggtggtcaagaagatg
aagaactactggcgacagctgctgaacgccaagctgattaccccagcggaag
ttcgataacctgaccaaggccgagagaggcggcctgagcgaacttgataag
gccggcttcattaagcggcagctggtggaaacccggcagatcaccaaacac
gtggcacagattctggactcccggatgaacactaagtacgacgagaatgac
```

```
aagctgatccgggaagtgaaagtcatcaccctgaagtctaagctggtgtcc
gatttccggaaggatttccagttctacaaagtgcgggaaatcaacaactac
catcacgcccacgacgcctacctgaatgccgttgttggaacagccctgatc
aagaagtatcccaagctggaaagcgagttcgtgtacggcgactacaaggtg
tacgacgtgcggaagatgatcgccaagagcgaacaagagatcggcaaggct
accgccaagtacttttctacagcaacatcatgaactttttcaagacagag
atcaccctggccaacggcgagatccggaaaagacccctgatcgagacaaac
ggcgaaaccggggagatcgtgtgggataagggcagagattttgccacagtg
cggaaagtgctgagcatgccccaagtgaatatcgtgaagaaaaccgaggtg
cagacaggcggcttcagcaaagagtctatcctgcctaagcggaacagcgat
aagctgatcgccagaaagaaggactgggaccctaagaagtacggcggcttc
gatagccctaccgtggcctattctgtgctggtggtggccaaagtggaaaag
ggcaagtccaaaaagctcaagagcgtgaaagagctgctggggatcaccatc
atggaaagaagcagctttgagaagaacccgatcgactttctggaagccaag
ggctacaaagaagtcaagaaggacctcatcatcaagctccccaagtacagc
ctgttcgagctggaaaatggccggaagcggatgctggcctcagcaggcgaa
ctgcagaaaggcaatgaactggccctgcctagcaaatacgtcaacttcctg
tacctggccagccactatgagaagctgaagggcagccccgaggacaatgag
caaaagcagctgtttgtggaacagcacaagcactacctggacgagatcatc
gagcagatcagcgagttctctccaagagagtgatcctggccgacgctaacctg
gataaggtgctgtctgcctataacaagcaccgggacaagcctatcagagag
caggccgagaatatcatccacctgtttaccctgaccaacctgggagcccct
gccgccttcaagtacttcgacaccaccatcgaccggaagaggtacaccagc
accaaagaggtgctggacgccacactgatccaccagtctatcaccggcctg
tacgaaacccggatcgacctgtctcagctcggcggcgattctggtggttct
ggcggaagtggcggatccaccaatctgagcgacatcatcgaaaagagaca
ggcaagcagctcgtgatccaagaatccatcctgatgctgcctgaagaggtt
gaggaagtgatcggcaacaagcctgagtccgacatcctggtgcacaccgcc
tacgatgagagcaccgatgagaacgtcatgctgctgacaagcgacgcccct
gagtacaagccttgggctctcgtgattcaggacagcaatgggagaacaag
atcaagatgctgagcggaggtagcggaggcagtggcggaagcacaaacctg
tctgatatcattgaaaagaaaccgggaagcaactggtcattcaagagtcc
attctcatgctcccggaagaagtcgaggaagtcattggaaacaaacccgag
agcgatattctggtccacacagcctatgacgagtctacagacgaaaacgtg
atgctcctgacctctgacgctcccgagtataagccctgggcacttgttatc
caggactctaacggggaaaacaaaatcaaaatgttgtccggcggcagcaag
cggacagccgatggatctgagttcgagagcccaagaagaaacggaaggtg
gagtaa,
```

By "base editing activity" is meant acting to chemically alter a base within a polynucleotide. In one embodiment, a first base is converted to a second base. In one embodiment, the base editing activity is cytidine deaminase activity, e.g., converting target C•G to T•A. In another embodiment, the base editing activity is adenosine deaminase activity, e.g., converting A•T to G•C.

The term "base editor system" refers to a system for editing a nucleobase of a target nucleotide sequence. In various embodiments, the base editor (BE) system comprises (1) a polynucleotide programmable nucleotide binding domain and a deaminase domain for deaminating the nucleobase; and (2) a guide polynucleotide (e.g., guide RNA) in conjunction with the polynucleotide programmable nucleotide binding domain. In some embodiments, the base editor system comprises (1) a base editor (BE) comprising a polynucleotide programmable DNA binding domain and a deaminase domain for deaminating the nucleobase; and (2) a guide RNA in conjunction with the polynucleotide programmable DNA binding domain. In some embodiments, the polynucleotide programmable nucleotide binding domain is a polynucleotide programmable DNA binding domain. In some embodiments, the base editor is a cytidine base editor (CBE). In some embodiments, the base editor is an adenine or adenosine base editor (ABE).

By "β-globin (HBB) protein" is meant a polypeptide or fragment thereof having at least about 95% amino acid sequence identity to the amino acid sequence of NCBI Accession No. NP_000509. In particular embodiments, a β-globin protein comprises one or more alterations relative to the following reference sequence. In one particular embodiment, a β-globin protein associated with sickle cell disease comprises an E6V (also termed E7V) mutation. An exemplary β-globin amino acid sequence (e.g., reference sequence) is provided below.

```
                                        (SEQ ID NO: 37)
  1 mvhltpeeks avtalwgkvn vdevggealg rllvvypwtg
    rffesfgdls tpdavmgnpk 61 vkahgkkvlg afsdglahld nlkgtfatls elhcdklhvd
    penfrllgnv lvcvlahhfg 121 keftppvqaa ygkvvagvan alahkyh
```

By "HBB polynucleotide" is meant a nucleic acid molecule encoding β-globin protein or a fragment thereof. The sequence of an exemplary HBB polynucleotide, which is available at NCBI Accession No. NM_000518, is provided below:

```
                                        (SEQ ID NO: 38)
  1 acatttgctt ctgacacaac tgtgttcact agcaacctca
    aacagacacc atggtgcatc 61 tgactcctga ggagaagtct gccgttactg ccctgtgggg
    caaggtgaac gtggatgaag 121 ttggtggtga ggccctgggc aggctgctgg tggtctaccc
    ttggacccag aggttctttg 181 agtcctttgg ggatctgtcc actcctgatg ctgttatggg
    caaccctaag gtgaaggctc 241 atggcaagaa agtgctcggt gcctttagtg atggcctggc
    tcacctggac aacctcaagg 301 gcacctttgc cacactgagt gagctgcact gtgacaagct
    gcacgtggat cctgagaact 361 tcaggctcct gggcaacgtg ctggtctgtg tgctggccca
    tcactttggc aaagaattca
```

```
                                        -continued
421 ccccaccagt gcaggctgcc tatcagaaag tggtggctgg
    tgtggctaat gccctggccc 481 acaagtatca ctaagctcgc tttcttgctg tccaatttct
    attaaaggtt cctttgttcc 541 ctaagtccaa ctactaaact gggggatatt atgaagggcc
    ttgagcatct ggattctgcc 601 taataaaaaa catttatttt cattgcaa
```

By "HBG1 protein," i.e., *Homo sapiens* hemoglobin subunit gamma 1 (HBG1) protein," is meant a polypeptide or fragment thereof having at least about 95% amino acid sequence identity to the amino acid sequence of NCBI Reference Sequence No. NM_000559.2. In some embodiments, an HBG1 protein may comprise one or more alterations relative to the following amino acid sequence. In a particular embodiment, edits are made to a regulatory region, e.g., promoter, associated with the HBG1 protein to treat or ameliorate sickle cell disease as described herein. An exemplary HBG1 amino acid sequence is provided below:

```
                                        (SEQ ID NO: 39)
MGHFTEEDKATITSLWGKVNVEDAGGETLGRLLVVYPWTQRFFDSFGNLSS

ASAINIGNPKVKAHGKKVLTSLGDATKHLDDLKGTFAQLSELHCDKLHVDP

ENFKLLGNVLVTVLAIHFGKEFTPEVQASWQKMVTAVASALSSRYH.
```

By "HBG1 polynucleotide" is meant a nucleic acid molecule encoding the HBG1 protein or a fragment thereof. The nucleic acid sequence of an exemplary HBG1 polynucleotide, is provided below:

```
                                        (SEQ ID NO: 40)
  1 acactcgctt ctggaacgtc tgaggttatc aataagctcc
    tagtccagac gccatgggtc 61 atttcacaga ggaggacaag gctactatca caagcctgtg
    gggcaaggtg aatgtggaag 121 atgctggagg agaaaccctg ggaaggctcc tggttgtcta
    cccatggacc cagaggttct 181 ttgacagctt tggcaacctg tcctctgcct ctgccatcat
    gggcaacccc aaagtcaagg 241 cacatggcaa gaaggtgctg acttccttgg gagatgccac
    aaagcacctg gatgatctca 301 agggcacctt tgcccagctg agtgaactgc actgtgacaa
    gctgcatgtg gatcctgaga 361 acttcaagct cctgggaaat gtgctggtga ccgttttggc
    aatccatttc ggcaaagaat 421 tcaccctga ggtgcaggct cctggcaga agatggtgac
    tgcagtggcc agtgccctgt 481 cctccagata ccactgagct cactgcccat gattcagagc
    tttcaaggat aggctttatt 541 ctgcaagcaa tacaaataat aaatctattc tgctgagaga
    tcac
```

By "HBG2 protein," i.e., *Homo sapiens* hemoglobin subunit gamma 2 (HBG2) protein," is meant a polypeptide or fragment thereof having at least about 95% amino acid sequence identity to the amino acid sequence of NCBI Reference Sequence No. NM_000184.3. In some embodiments, an HBG2 protein may comprise one or more alterations relative to the following amino acid sequence. In a particular embodiment, edits are made to a regulatory region, e.g., promoter, associated with the HBG2 protein to treat or ameliorate sickle cell disease as described herein. An exemplary HBG2 amino acid sequence is provided below:

(SEQ ID NO: 41)
MGHFTEEDKATITSLWGKVNVEDAGGETLGRLLVVYPWTQRFFDSFGNLSS

ASAIMGNPKVKAHGKKVLTSLGDAIKHLDDLKGTFAQLSELHCDKLHVDPE

NFKLLGNVLVTVLAIHFGKEFTPEVQASWQKMVTGVASALSSRYH

By "HBG2 polynucleotide" is meant a nucleic acid molecule encoding the HBG2 protein or a fragment thereof. The nucleic acid sequence of an exemplary HBG2 polynucleotide, is provided below:

```
                                                (SEQ ID NO: 42)
  1 acactcgctt ctggaacgtc tgaggttatc aataagctcc
    tagtccagac gccatgggtc 61 atttcacaga ggaggacaag gctactatca caagcctgtg
    gggcaaggtg aatgtggaag 121 atgctggagg agaaaccctg ggaaggctcc tggttgtcta
    cccatgacc cagaggttct 181 ttgacagctt tggcaacctg tcctctgcct ctgccatcat
    gggcaacccc aaagtcaagg 241 cacatggcaa gaaggtgctg acttccttgg gagatgccat
    aaagcacctg gatgatctca 301 agggcacctt tgcccagctg agtgaactgc actgtgacaa
    gctgcatgtg gatcctgaga 361 acttcaagct cctgggaaat gtgctggtga ccgttttggc
    aatccatttc ggcaaagaat 421 tcacccctga ggtgcaggct tcctggcaga agatggtgac
    tggagtggcc agtgccctgt 481 cctccagata ccactgagct cactgcccat gatgcagagc
    tttcaaggat aggctttatt 541 ctgcaagcaa tcaaataata aatctattct gctaagagat
    cacaca
```

By "ALAS1 protein," i.e., Homo sapiens 5'-aminolevulinate synthase 1 (ALAS1) protein," is meant a polypeptide or fragment thereof having at least about 95% amino acid sequence identity to the amino acid sequence of NCBI Reference Sequence No. NM_000688.6. In some embodiments, an ALAS1 protein may comprise one or more alterations relative to the following amino acid sequence. In a particular embodiment, edits are made to a regulatory region, e.g., promoter, associated with the ALAS1 protein to treat or ameliorate sickle cell disease as described herein. An exemplary ALAS1 amino acid sequence is provided below:

(SEQ ID NO: 43)
MESVVRRCPFLSRVPQAFLQKAGKSLLFYAQNCPKMMEVGAKPAPRALSTA

AVHYQQIKETPPASEKDKTAKAKVQQTPDGSQQSPDGTQLPSGHPLPATSQ

GTASKCPFLAAQMNQRGSSVFCKASLELQEDVQEMNAVRKEVAETSAGPSV

VSVKTDGGDPSGLLKNFQDIMQKQRPERVSHLLQDNLPKSVSTFQYDRFFE

KKIDEKKNDHTYRVEKTVNRRAHIFPMADDYSDSLITKKQVSVWCSNDYLG

MSRHPRVCGAVMDTLKQHGAGAGGTRNISGTSKFHVDLERELADLHGKDAA

LLFSSCFVANDSTLFTLAKMMPGCEIYSDSGNHASMIQGIRNSRVPKYIFR

HNDVSHLRELLQRSDPSVPKIVAFETVHSMDGAVCPLEELCDVAHEFGAIT

-continued

FVDEVHAVGLYGARGGGIGDRDGVMPKMDIISGTLGKAFGCVGGYIASTSS

LIDTVRSYAAGFIFTTSLPPMLLAGALESVRILKSAEGRVLRRQHQRNVKL

MRQMLMDAGLPVVHCPSHIIPVRVADAAKNTEVCDELMSRHNIYVQAINYP

TVPRGEELLRIAPTPHHTPQMMNYFLENLLVTWKQVGLELKPHSSAECNFC

RRPLHFEVMSEREKSYFSGLSKLVSAQA

By "ALAS1 polynucleotide" is meant a nucleic acid molecule encoding the ALAS1 protein or a fragment thereof. The nucleic acid sequence of an exemplary ALAS1 polynucleotide, is provided below:

```
                                                (SEQ ID NO: 44)
aggctgctcc cggacaaggg caacgagcgt ttcgtttgga cttctcgact tgagtgcccg cctccttcgc cgccgcctct gcagtcctca gcgcagttat gcccagttct tcccgctgtg gggacacgac cacggaggaa tccttgcttc agggactcgg gaccctgctg gacccttcc tcgggtttag gggatgtggg gaccaggaga aagtcaggat ccctaagagt cttccctgcc tggatggatg agtggcttct tctccaccta gattctttcc acaggagcca gcatacttcc tgaacatgga gagtgttgtt cgccgctgcc cattcttatc ccgagtcccc caggcctttc tgcagaaagc aggcaaatct ctgttgttct atgcccaaaa ctgccccaag atgatggaag ttggggccaa gccagcccct cgggcattgt ccactgcagc agtacactac caacagatca aagaaacccc tccggccagt gagaaagaca aaactgctaa ggccaaggtc caacagactc ctgatggatc ccagcagagt ccagatggca cacagcttcc gtctggacac cccttgcctg ccacaagcca gggcactgca agcaaatgcc cttttcctggc agcacagatg aatcagagag gcagcagtgt cttctgcaaa gccagtcttg agcttcagga ggatgtgcag gaaatgaatg ccgtgaggaa agaggttgct gaaacctcag caggccccag tgtggttagt gtgaaaaccg atggaggga tcccagtgga ctgctgaaga acttccagga catcatgcaa aagcaaagac cagaaagagt gtctcatctt cttcaagata acttgccaaa atctgtttcc acttttcagt atgatcgttt ctttgagaaa aaaattgatg agaaaaagaa tgaccacacc tatcgagttt ttaaaactgt gaaccggcga gcacacatct tccccatggc agatgactat tcagactccc tcatcaccaa aaagcaagtg tcagtctggt gcagtaatga ctacctagga atgagtcgcc acccacgggt gtgtggggca gttatggaca cttttgaaaca acatggtgct ggggcaggtg gtactagaaa tatttctgga actagtaaat tccatgtgga cttagagcgg gagctggcag acctccatgg gaaagatgcc gcactcttgt tttcctcgtg
```

```
ctttgtggcc aatgactcaa ccctcttcac cctggctaag atgatgccag gctgtgagat ttactctgat tctgggaacc atgcctccat gatccaaggg attcgaaaca gccgagtgcc aaagtacatc ttccgccaca atgatgtcag ccacctcaga gaactgctgc aaagatctga cccctcagtc cccaagattg tggcatttga aactgtccat tcaatggatg gggcggtgtg cccactggaa gagctgtgtg atgtggccca tgagtttgga gcaatcacct tcgtggatga ggtccacgca gtggggcttt atggggctcg aggcggaggg attggggatc gggatggagt catgccaaaa atggacatca tttctggaac acttggcaaa gcctttggtt gtgttggagg gtacatcgcc agcacgagtt ctctgattga caccgtacgg tcctatgctg ctggcttcat cttcaccacc tctctgccac ccatgctgct ggctggagcc ctggagtctg tgcggatcct gaagagcgct gagggacggg tgcttcgccg ccagcaccag cgcaacgtca aactcatgag acagatgcta atggatgccg gcctccctgt tgtccactgc cccagccaca tcatccctgt gcgggttgca gatgctgcta aaaacacaga agtctgtgat gaactaatga gcagacataa catctacgtg caagcaatca attaccctac ggtgccccgg ggagaagagc tcctacggat tgcccccacc cctcaccaca cacccagat gatgaactac ttccttgaga atctgctagt cacatggaag caagtggggc tggaactgaa gcctcattcc tcagctgagt gcaacttctg caggaggcca ctgcattttg aagtgatgag tgaaagagag aagtcctatt tctcaggctt gagcaagttg gtatctgctc aggcctgagc atgacctcaa ttatttcact taaccccagg ccattatcat atccagatgg tcttcagagt tgtctttata tgtgaattaa gttatattaa attttaatct atagtaaaaa catagtcctg gaaatgaaatt cttgcttaaa tggtg
```

By "BCL11A"protein," i.e., *Homo sapiens* B-cell CLI/lymphoma 11A (BCL11A) protein," (zinc finger protein) is meant a polypeptide or fragment thereof having at least about 95% amino acid sequence identity to the amino acid sequence of GenBank Accession No. ADL_14508.1. In some embodiments, a BCL11A protein may comprise one or more alterations relative to the following amino acid sequence. In a particular embodiment, base editing occurs in a regulatory region, e.g., promoter, of or associated with the BCL11A protein to treat or ameliorate diseases such as beta thalassemia and sickle cell disease (SCD), e.g., by increasing fetal hemoglobin production. The BCL11A-encoding gene is highly expressed in several hematopoietic lineages and plays a role in the switch from γ- to β-globin expression during the transition from fetal to adult erythropoiesis. BCL11A may play a role in the suppression of fetal hemoglobin production. It may also be involved in lymphoma pathogenesis; translocations associated with B-cell malignancies have been found to deregulate the expression of BCL11A. An exemplary human BCL11A amino acid sequence is provided below:

(SEQ ID NO: 45)

MSRRKQGKPQHLSKREFSPEPLEAILTDDEPDHGPLGAPEGDHDLLTCGQC

QMNFPLGDILIFIEHKRKQCNGSLCLEKAVDKPPSPSPIEMKKASNPVEVG

IQVTPEDDDCLSTSSRGICPKQEHIADKLLHWRGLSSPRSAHGALIPTPGM

SAEYAPQGICKDEPSSYTCTTCKQPFTSAWFLLQHAQNTHGLRIYLESEHG

SPLTPRVGIPSGLGAECPSQPPLHGIHIADNNPFNLLRIPGSVSREASGLA

EGRFPPTPPLFSPPPRHHLDPHRIERLGAEEMALATHHPSAFDRVLRLNPM

AMEPPAMDFSRRLRELAGNTSSPPLSPGRPSPMQRLLQPFQPGSKPPFLAT

PPLPPLQSAPPPSQPPVKSKSCEFCGKTFKFQSNLVVHRRSHTGEKPYKCN

LCDHACTQASKLKRHMKTHMHKSSPMTVKSDDGLSTASSPEPGTSDLVGSA

SSALKSVVAKFKSENDPNLIPENGDEEEEEDDEEEEEEEEEEEELTESER

VDYGFGLSLEAARHHENSSRGAVVGVGDESRALPDVMQGMVLSSMQHFSEA

FHQVLGEKHKRGHLAEAEGHRDTCDEDSVAGESDRIDDGTVNGRGCSPGES

ASGGLSKKLLLGSPSSLSPFSKRIKLEKEFDLPPAAMPNTENVYSQWLAGY

AASRQLKDPFLSFGDSRQSPFASSSEHSSENGSLRFSTPPGELDGGISGRS

GTGSGGSTPHISGPGPGRPSSKEGRRSDTCEYCGKVFKNCSNLTVHRRSHT

GERPYKCELCNYACAQSSKLTRHMKTHGQVGKDVYKCEICKMPFSVYSTLE

KHMKKWHSDRVLNNDIKTE

By "BCL11A polynucleotide" is meant a nucleic acid molecule encoding the BCL11A protein or a fragment thereof. The nucleic acid sequence of an exemplary human BCL11A (isoform 1) polynucleotide, Reference Sequence No. GU324937.1, is provided below:

(SEQ ID NO: 46)
```
atgtctcgccgcaagcaaggcaaaccccagcacttaagcaaacgggaattc tcgcccgagcctcttgaagccattcttacagatgatgaaccagaccacggc ccgttgggagctccagaagggatcatgacctcctcacctgtgggcagtgc cagatgaacttcccattggggacattcttatttttatcgagcacaaacgg aaacaatgcaatggcagcctctgcttagaaaaagctgtggataagccacct tccccttcaccaatcgagatgaaaaaagcatccaatcccgtggaggttggc atccaggtcacgccagaggatgacgattgtttatcaacgtcatctagagga atttgccccaaacaggaacacatagcagataaacttctgcactggaggggc ctctcctccccctcgttctgcacatggagctctaatcccacgcctgggatg agtgcagaatatgccccgcagggtatttgtaaagatgagcccagcagctac acatgtacaacttgcaaacagccattcaccagtgcatggtttctcttgcaa cacgcacagaacactcatggattaagaatctacttagaaagcgaacacgga agtcccctgaccccgcgggttggtatcccttcaggactaggtgcagaatgt ccttcccagccacctctccatgggattcatattgcagacaataacccctttt aacctgctaagaataccaggatcagtatcgagagaggcttccggcctggca gaagggcgctttccacccactcccccctgtttagtccaccaccgagacat
```

-continued
```
cacttggaccccaccgcatagagcgcctgggggcggaagagatggccctg gccacccatcacccgagtgcctttgacagggtgctgcggttgaatccaatg gctatggagcctcccgccatggatttctctaggagacttagagagctggca gggaacacgtctagcccaccgctgtcccaggccggcccagccctatgcaa aggttactgcaaccattccagccaggtagcaagccgcccttcctggcgacg ccccccctcctcctctgcaatccgcccctcctcctcccagccccggtc aagtccaagtcatgcgagttctgcggcaagacgttcaaatttcagagcaac ctggtggtgcaccggcgcagccacacgggcgagaagccctacaagtgcaac ctgtgcgaccacgcgtgcacccaggccagcaagctgaagcgccacatgaag acgcacatgcacaaatcgtcccccatgacggtcaagtccgacgacggtctc tccaccgccagctccccggaacccggcaccagcgacttggtgggcagcgcc agcagcgcgctcaagtccgtggtggccaagttcaagagcgagaacgacccc aacctgatcccggagaacggggacgaggaggaagaggaggacgacgaggaa gaggaagaagaggaggaagaggaggaggagctgacggagagcgagagg gtggactacggcttcgggctgagcctggaggcggcgcgccaccacgagaac agctcgcggggcgcggtcgtgggcgtgggcgacgagagccgcgccctgccc gacgtcatgcagggcatggtgctcagctccatgcagcacttcagcgaggcc ttccaccaggtcctgggcgagaagcataagcgcggccacctggccgaggcc gagggccacaggacacttgcgacgaagactcggtggccggcgagtcggac cgcatagacgatggcactgttaatggccgcggctgctccccgggcgagtcg gcctcggggggcctgtccaaaaagctgctgctgggcagcccagctcgctg agccccttctctaagcgcatcaagctcgagaaggagttcgacctgccccg gccgcgatgcccaacacggagaacgtgtactcgcagtggctcgccggctac gcggcctccaggcagctcaaagatcccttccttagcttcggagactccaga caatcgccttttgcctcctcgtcggagcactcctcggagaacgggagcttg cgcttctccacaccgccggggagctggacggagggatctcggggcgcagc ggcacgggaagtggagggagcacgccccatattagtggtccgggcccgggc aggcccagctcaaaagagggcagacgcagcgacacttgtgagtactgtggg aaagtcttcaagaactgtagcaatctcactgtccacaggagaagccacacg ggcgaaaggccttataaatgcgagctgtgcaactatgcctgtgcccagagt agcaagctcaccaggcacatgaaaacgcatggccaggtggggaaggacgtt tacaaatgtgaaatttgtaagatgccttttagcgtgtacagtaccctggag aaacacatgaaaaaatggcacagtgatcgagtgttgaataatgatataaaa actgaatag.
```

In some embodiments, a nucleobase editor system may comprise more than one base editing component. For example, a nucleobase editor system may include more than one deaminase. In some embodiments, a nuclease base editor system may include one or more cytidine deaminase and/or one or more adenosine deaminases. In some embodiments, a single guide polynucleotide may be utilized to target different deaminases to a target nucleic acid sequence. In some embodiments, a single pair of guide polynucleotides may be utilized to target different deaminases to a target nucleic acid sequence.

The nucleobase component and the polynucleotide programmable nucleotide binding component of a base editor system may be associated with each other covalently or non-covalently. For example, in some embodiments, a deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the nucleobase editing component, e.g. the deaminase component can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or a RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the nucleobase editing component of the base editor system, e.g. the deaminase component, can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a base excision repair inhibitor. In some embodiments, the inhibitor of base excision repair can be a uracil DNA glycosylase inhibitor (UGI). In some embodiments, the inhibitor of base excision repair can be an inosine base excision repair inhibitor. In some embodiments, the inhibitor of base excision repair can be targeted to the target nucleotide sequence by the polynucleotide programmable nucleotide binding domain. In some embodiments, a polynucleotide programmable nucleotide binding domain can be fused or linked to an inhibitor of base excision repair. In some embodiments, a polynucleotide programmable nucleotide binding domain can be fused or linked to a deaminase domain and an inhibitor of base excision repair. In some embodiments, a polynucleotide programmable nucleotide binding domain can target an inhibitor of base excision repair to a target nucleotide sequence by noncovalently interacting with or associating with the inhibitor of base excision repair. For example, in some embodiments, the inhibitor of base excision repair component can comprise an additional heterologous portion or domain that is capable of interacting with, associating with, or capable of forming a complex with an additional heterologous portion or domain that is part of a polynucleotide programmable nucleotide binding domain. In some embodiments, the inhibitor of base excision repair can be targeted to the target nucleotide sequence by the guide polynucleotide. For example, in some embodiments, the inhibitor of base excision repair can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of base excision repair. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

The term "Cas9" or "Cas9 domain" refers to an RNA guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casn1 nuclease or a CRISPR (clustered regularly interspaced short palindromic repeat) associated nuclease. An exemplary Cas9, is *Streptococcus pyogenes* Cas9, the amino acid sequence of which is provided below:

```
                                        (SEQ ID NO: 47)
MDKKYSIGLDIGTNSVGWAVITDDYKVPSKKFKVLGNTDRHSIKKNLIGAL

LFGSGETAEATRLKRTARRRYTRRKNRICYLQEIFSNEMAKVDDSFFHRLE

ESFLVEEDKKHERHPIFGNIVDEVAYHEKYPTIYHLRKKLADSTDKADLRL

IYLALAHMIKFRGHFLIEGDLNPDNSDVDKLFIQLVQIYNQLFEENPINAS

RVDAKAILSARLSKSRRLENLIAQLPGEKRNGLFGNLIALSLGLTPNFKSN

FDLAEDAKLQLSKDTYDDDLDNLLAQIGDQYADLFLAAKNLSDAILLSDIL

RVNSEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGAYHDLLKIIKDKDFLDNEEN

EDILEDIVLTLTLFEDRGMIEERLKTYAHLFDDKVMKQLKRRRYTGWGRLS

RKLINGIRDKQSGKTILDFLKSDGFANRNFMQLIHDDSLTFKEDIQKAQVS

GQGHSLHEQIANLAGSPAIKKGILQTVKIVDELVKVMGHKPENIVIEMARE

NQTTQKGQKNSRERMKRIEEGIKELGSQILKEHPVENTQLQNEKLYLYYLQ

NGRDMYVDQELDINRLSDYDVDHIVPQSFIKDDSIDNKVLTRSDKNRGKSD

NVPSEEVVKKMKNYWRQLLNAKLITQRKFDNLTKAERGGLSELDKAGFIKR

QLVETRQITKHVAQILDSRMNTKYDENDKLIREVKVITLKSKLVSDFRKDF

QFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARK

KDWDPKKYGGFDSPTVAYSVLVVAKVEKGKSKKLKSVKELLGITIMERSSF

EKNPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQISEF

SKRVILADANLDKVLSAYNKHRDKPIREQAENIIHLFTLTNLGAPAAFKYF

DTTIDRKRYTSTKEVLDATLIHQSITGLYETRIDLSQLGGD
(single underline: HNH domain; double underline:
RuvC domain).
```

The term "conservative amino acid substitution" or "conservative mutation" refers to the replacement of one amino acid by another amino acid with a common property. A functional way to define common properties between individual amino acids is to analyze the normalized frequencies of amino acid changes between corresponding proteins of homologous organisms (Schulz, G. E. and Schirmer, R. H., Principles of Protein Structure, Springer-Verlag, New York (1979)). According to such analyses, groups of amino acids can be defined where amino acids within a group exchange preferentially with each other, and therefore resemble each other most in their impact on the overall protein structure (Schulz, G. E. and Schirmer, R. H., supra). Non-limiting examples of conservative mutations include amino acid substitutions of amino acids, for example, lysine for arginine and vice versa, such that a positive charge can be maintained; glutamic acid for aspartic acid and vice versa, such that a negative charge can be maintained; serine for threonine, such that a free —OH can be maintained; and glutamine for asparagine, such that a free —NH$_2$ can be maintained.

The term "coding sequence" or "protein coding sequence" as used interchangeably herein, refers to a segment of a polynucleotide that codes for a protein. The region or sequence is bounded nearer the 5' end by a start codon and nearer the 3' end with a stop codon. Coding sequences can also be referred to as open reading frames.

The term "deaminase" or "deaminase domain," as used herein, refers to a protein or enzyme that catalyzes a deamination reaction. In some embodiments, the deaminase or deaminase domain is a cytidine deaminase, catalyzing the hydrolytic deamination of cytidine or deoxycytidine to uridine or deoxyuridine, respectively. In some embodiments, the deaminase or deaminase domain is a cytosine deaminase, catalyzing the hydrolytic deamination of cytosine to uracil. In some embodiments, the deaminase is an adenosine deaminase, which catalyzes the hydrolytic deamination of adenine to hypoxanthine. In some embodiments, the deaminase is an adenosine deaminase, which catalyzes the hydrolytic deamination of adenosine or adenine (A) to inosine (I). In some embodiments, the deaminase or deaminase domain is an adenosine deaminase, catalyzing the hydrolytic deamination of adenosine or deoxyadenosine to inosine or deoxyinosine, respectively. In some embodiments, the adenosine deaminase catalyzes the hydrolytic deamination of adenosine in deoxyribonucleic acid (DNA). The adenosine deaminases (e.g. engineered adenosine deaminases, evolved adenosine deaminases) provided herein can be from any organism, such as a bacterium. In some embodiments, the adenosine deaminase is from a bacterium, such as *E. coli, S. aureus, S. typhi, S. putrefaciens, H. influenzae,* or *C. crescentus*. In some embodiments, the adenosine deaminase is a TadA deaminase. In some embodiments, the deaminase or deaminase domain is a variant of a naturally occurring deaminase from an organism, such as a human, chimpanzee, gorilla, monkey, cow, dog, rat, or mouse. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 91%, at least 92%, at least 93%, at least 94%, at least 95%, at least 96%, at least 97%, at least 98%, at least 99%, at least 99.1%, at least 99.2%, at least 99.3%, at least 99.4%, at least 99.5%, at least 99.6%, at least 99.7%, at least 99.8%, or at least 99.9% identical to a naturally occurring deaminase. For example, deaminase domains are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

By "detectable label" is meant a composition that when linked to a molecule of interest renders the latter detectable, via spectroscopic, photochemical, biochemical, immunochemical, or chemical means. For example, useful labels include radioactive isotopes, magnetic beads, metallic beads, colloidal particles, fluorescent dyes, electron-dense reagents, enzymes (for example, as commonly used in an ELISA), biotin, digoxigenin, or haptens.

By "disease" is meant any condition or disorder that damages or interferes with the normal function of a cell, tissue, or organ. Examples of diseases include retinitis pigmentosa, Usher syndrome, sickle cell disease, beta-thalassemia, Hereditary Persistence of Fetal Hemoglobin (HPFH), alpha-1 antitrypsin deficiency (A1AD), hepatic *porphyria*, medium-chain acyl-CoA dehydrogenase (ACADM) deficiency, lysosomal acid lipase (LAL) deficiency, phenylketonuria, hemochromatosis, Von Gierke disease, Pompe disease, Gaucher disease, Hurler syndrome, cystic fibrosis, or chronic pain. In an embodiment, the disease is A1AD. In an embodiment, the disease is sickle cell disease (SCD), also termed "sickle cell anemia."

By "effective amount" is meant the amount of an agent or active compound, e.g., a base editor as described herein, that is required to ameliorate the symptoms of a disease in a subject or patient in need thereof, relative to an untreated patient or an individual without disease, i.e., a healthy individual. The effective amount of active compound(s) used to practice the described methods for therapeutic treatment of a disease varies depending upon the manner of administration, the age, body weight, and general health of the subject. Ultimately, the attending physician or veterinarian will decide the appropriate amount and dosage regimen. Such amount is referred to as an "effective" amount. In one embodiment, an effective amount is the amount of a base editor of the invention sufficient to introduce an alteration in a gene of interest in a cell (e.g., a cell in vitro or in vivo). In one embodiment, an effective amount is the amount of a base editor required to achieve a therapeutic effect (e.g., to reduce or control retinitis pigmentosa, Usher syndrome, sickle cell disease (SCD), beta-thalassemia, Hereditary Persistence of Fetal Hemoglobin (HPFH), alpha-1 antitrypsin deficiency (A1AD), hepatic *porphyria*, medium-chain acyl-CoA dehydrogenase (ACADM) deficiency, lysosomal acid lipase (LAL) deficiency, phenylketonuria, hemochromatosis, Von Gierke disease, Pompe disease, Gaucher disease, Hurler syndrome, cystic fibrosis, or chronic pain. Such therapeutic effect need not be sufficient to alter a pathogenic gene in all cells of a subject, tissue or organ, but only to alter the pathogenic gene in about 1%, 5%, 10%, 25%, 50%, 75% or more of the cells present in a subject, tissue or organ. In one embodiment, an effective amount is sufficient to ameliorate one or more symptoms of a disease (e.g., retinitis pigmentosa, Usher syndrome, sickle cell disease (SCD), beta-thalassemia, Hereditary Persistence of Fetal Hemoglobin (HPFH), alpha-1 antitrypsin deficiency (A1AD), hepatic *porphyria*, medium-chain acyl-CoA dehydrogenase (ACADM) deficiency, lysosomal acid lipase (LAL) deficiency, phenylketonuria, hemochromatosis, Von Gierke disease, Pompe disease, Gaucher disease, Hurler syndrome, cystic fibrosis, or chronic pain).

By "fragment" is meant a portion of a polypeptide or nucleic acid molecule. Ibis portion contains, preferably, at least 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

"Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds The term "inhibitor of base repair" or "IBR" refers to a protein that is capable in inhibiting the activity of a nucleic acid repair enzyme, for example a base excision repair enzyme. In some embodiments, the IBR is an inhibitor of inosine base excision repair. Exemplary inhibitors of base repair include inhibitors of APE1, Endo III, Endo IV, Endo V, Endo VIII, Fpg, hOGG1, hNEIL1, T7 EndoI, T4PDG, UDG, hSMUG1, and hAAG. In some embodiments, the IBR is an inhibitor of Endo V or hAAG. In some embodiments, the IBR is a catalytically inactive EndoV or a catalytically inactive hAAG. In some embodiments, the base repair inhibitor is an inhibitor of Endo V or hAAG. In some embodiments, the base repair inhibitor is a catalytically inactive EndoV or a catalytically inactive hAAG. In some embodiments, the base repair inhibitor is uracil glycosylase inhibitor (UGI). UGI refers to a protein that is capable of inhibiting a uracil-DNA glycosylase base-excision repair enzyme. In some embodiments, a UGI domain comprises a wild-type UGI or a fragment of a wild-type UGI. In some embodiments, the UGI proteins provided herein include fragments of UGI and proteins homologous to a UGI or a UGI fragment. In some embodiments, the base repair inhibitor is an inhibitor of inosine base excision repair. In some embodiments, the base repair inhibitor is a "catalytically inactive inosine specific nuclease" or "dead inosine specific nuclease." Without wishing to be bound by any particular theory, catalytically inactive inosine glycosylases (e.g., alkyl adenine glycosylase (AAG)) can bind inosine, but cannot create an abasic site or remove the inosine, thereby sterically blocking the newly formed inosine moiety from DNA damage/repair mechanisms. In some embodiments, the catalytically inactive inosine specific nuclease can be capable of binding an inosine in a nucleic acid but does not cleave the nucleic acid. Non-limiting exemplary catalytically inactive inosine specific nucleases include catalytically inactive alkyl adenosine glycosylase (AAG nuclease), for example, from a human, and catalytically inactive endonuclease V (EndoV nuclease), for example, from E. coli. In some embodiments, the catalytically inactive AAG nuclease comprises an E125Q mutation or a corresponding mutation in another AAG nuclease.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high-performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

The term "linker", as used herein, can refer to a covalent linker (e.g., covalent bond), a non-covalent linker, a chemical group, or a molecule linking two molecules or moieties, e.g., two components of a protein complex or a ribonucleo-complex, or two domains of a fusion protein, such as, for example, a polynucleotide programmable DNA binding domain (e.g., dCas9) and a deaminase domain (e.g., an adenosine deaminase or a cytidine deaminase). A linker can join different components of, or different portions of components of, a base editor system. For example, in some embodiments, a linker can join a guide polynucleotide binding domain of a polynucleotide programmable nucleotide binding domain and a catalytic domain of a deaminase. In some embodiments, a linker can join a CRISPR polypeptide and a deaminase. In some embodiments, a linker can join a Cas9 and a deaminase. In some embodiments, a linker can join a dCas9 and a deaminase. In some embodiments, a linker can join a nCas9 and a deaminase. In some embodiments, a linker can join a guide polynucleotide and a deaminase. In some embodiments, a linker can join a deaminating component and a polynucleotide programmable nucleotide binding component of a base editor system. In some embodiments, a linker can join a RNA-binding portion of a deaminating component and a polynucleotide programmable nucleotide binding component of a base editor system. In some embodiments, a linker can join a RNA-binding portion of a deaminating component and a RNA-binding portion of a polynucleotide programmable nucleotide binding component of a base editor system. A linker can be positioned between, or flanked by, two groups, molecules, or other moieties and connected to each one via a covalent bond or non-covalent interaction, thus connecting the two. In some embodiments, the linker can be an organic molecule, group, polymer, or chemical moiety. In some embodiments, the linker can be a polynucleotide. In some embodiments, the linker can be a DNA linker. In some embodiments, the linker can be a RNA linker. In some embodiments, a linker can comprise an aptamer capable of binding to a ligand. In some embodiments, the ligand may be carbohydrate, a peptide, a protein, or a nucleic acid. In some embodiments, the linker may comprise an aptamer may be derived from a riboswitch. The riboswitch from which the aptamer is derived may be selected from a theophylline riboswitch, a thiamine pyrophosphate (TPP) riboswitch, an adenosine cobalamin (AdoCbl) riboswitch, an S-adenosyl methionine (SAM) riboswitch, an SAH riboswitch, a flavin mononucleotide (FMN) riboswitch, a tetrahydrofolate riboswitch, a lysine riboswitch, a glycine riboswitch, a purine riboswitch, a GlmS riboswitch, or a prequeosinel (PreQ1) riboswitch. In some embodiments, a linker may comprise an aptamer bound to a polypeptide or a protein domain, such as a polypeptide ligand. In some embodiments, the polypeptide ligand may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif. In some embodiments, the polypeptide ligand may be a portion of a base editor system component. For example, a nucleobase editing component may comprise a deaminase domain and a RNA recognition motif.

In some embodiments, the linker can be an amino acid or a plurality of amino acids (e.g., a peptide or protein). In some embodiments, the linker can be about 5-100 amino acids in length, for example, about 5, 6, 7, 8, 9, 10, 11, 12, 13, 14, 15, 16, 17, 18, 19, 20, 20-30, 30-40, 40-50, 50-60, 60-70, 70-80, 80-90, or 90-100 amino acids in length. In some embodiments, the linker can be about 100-150, 150-200, 200-250, 250-300, 300-350, 350-400, 400-450, or 450-500 amino acids in length. Longer or shorter linkers can be also contemplated.

In some embodiments, a linker joins a gRNA binding domain of an RNA-programmable nuclease, including a Cas9 nuclease domain, and the catalytic domain of a nucleic-acid editing protein (e.g., cytidine or adenosine deaminase). In some embodiments, a linker joins a dCas9 and a nucleic-acid editing protein. For example, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-200 amino acids in length, for example, 5, 6, 7, 8, 9, 10, 11, 12, 13, 14, 15, 16, 17, 18, 19, 20, 25, 35, 45, 50, 55, 60, 60, 65, 70, 70, 75, 80, 85, 90, 90, 95, 100, 101, 102, 103, 104, 105, 110, 120, 130, 140, 150, 160, 175, 180, 190, or 200 amino acids in length. Longer or shorter linkers are also contemplated. In some embodiments, a linker comprises the amino acid sequence SGSETPGTSESATPES (SEQ ID NO: 48), which may also be referred to as the XTEN linker. In some embodiments, a linker comprises the amino acid sequence SGGS (SEQ ID NO: 49). In some embodiments, a linker comprises (SGGS)$_n$ (SEQ ID NO: 50), (GGGS)$_n$ (SEQ ID NO: 51), (GGGGS)$_n$ (SEQ ID NO: 52), (G)$_n$ (SEQ ID NO: 53), (EAAAK)$_n$ (SEQ ID NO: 54), (GGS)$_n$ (SEQ ID NO: 55), SGSETPGTSESATPES (SEQ ID NO: 48), or (XP)$_n$ (SEQ ID NO: 56) motif, or a combination of any of these, where n is independently an integer between 1 and 30, and where X is any amino acid. In some embodiments, n is 1, 2, 3, 4, 5, 6, 7, 8, 9, 10, 11, 12, 13, 14, or 15. In some embodiments, a linker comprises a plurality of proline residues and is 5-21, 5-14, 5-9, 5-7 amino acids in length, e.g., PAPAP (SEQ ID NO: 57), PAPAPA (SEQ ID NO: 58), PAPAPAP (SEQ ID NO: 59), PAPAPAPA (SEQ ID NO: 60), P(AP)$_4$ (SEQ ID NO: 61), P(AP)$_7$ (SEQ ID NO: 62), P(AP)$_{10}$ (SEQ ID NO: 63). Such proline-rich linkers are also termed "rigid" linkers.

In some embodiments, the domains of a base editor are fused via a linker that comprises the amino acid sequence of SGGSSGGSETPGTSESATPESSGGS (SEQ ID NO: 64), SGGSSGGSSGSETPGTSESATPESSGGSSGGS (SEQ ID NO: 65), or GGSGGSPGSPAGSPTSTEEGTSESAT-PESGPGTSTEPSEGSAPGSPAGSPTSTEEGTSTE PSEGSAPGTSTEPSEGSAPGTSESAT-PESGPGSEPATSGGSGGS (SEQ ID NO: 229). In some embodiments, domains of the base editor are fused via a linker comprising the amino acid sequence SGSETPGTS-ESATPES (SEQ ID NO: 48), which may also be referred to as the XTEN linker. In some embodiments, the linker is 24 amino acids in length. In some embodiments, the linker comprises the amino acid sequence SGGSSGGSSG-SETPGTSESATPES (SEQ ID NO: 21). In some embodiments, the linker is 40 amino acids in length. In some embodiments, the linker comprises the amino acid sequence SGGSSGGSSGSETPGTSESAT-PESSGGSSGGSSGGSSGGS (SEQ ID NO: 68). In some embodiments, the linker is 64 amino acids in length. In some embodiments, the linker comprises the amino acid sequence SGGSSGGSSGSETPGTSESAT-PESSGGSSGGSSGGSSGGSSGGSETPGTSESAT-PESSGGSSG GS (SEQ ID NO: 69). In some embodiments, the linker is 92 amino acids in length. In some embodiments, the linker comprises the amino acid sequence PGSPAGSPT-STEEGTSESATPESGPGTSTEPSEGSAPGSPAGSPT-STEEGTSTEPSEGSAP GTSTEPSEGSAPGTSESAT-PESGPGSEPATS (SEQ ID NO: 70).

The term "mutation", as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, Molecular Cloning: A Laboratory Manual (4th ed., Cold Spring Harbor Laboratory Press, Cold Spring Harbor, N.Y. (2012)). In some embodiments, the presently disclosed base editors can efficiently generate an "intended mutation," such as a point mutation, in a nucleic acid (e.g., a nucleic acid within a genome of a subject) without generating a significant number of unintended mutations, such as unintended point mutations. In some embodiments, an intended mutation is a mutation that is generated by a specific base editor (e.g., a cytidine base editor or an adenosine base editor) bound to a guide polynucleotide (e.g., gRNA), specifically designed to generate the intended mutation.

In general, mutations made or identified in a sequence (e.g., an amino acid sequence as described herein) are numbered in relation to a reference (or wild type) sequence, i.e., a sequence that does not contain the mutations. The skilled practitioner in the art would readily understand how to determine the position of mutations in amino acid and nucleic acid sequences relative to a reference sequence.

The term "nuclear localization sequence," "nuclear localization signal," or "NLS" refers to an amino acid sequence that promotes import of a protein into the cell nucleus. Nuclear localization sequences are known in the art and described, for example, in Plank et al., International PCT application, PCT/EP2000/011690, filed Nov. 23, 2000, published as WO/2001/038547 on May 31, 2001, the contents of which are incorporated herein by reference for their disclosure of exemplary nuclear localization sequences. In other embodiments, the NLS is an optimized NLS described, for example, by Koblan et al., Nature Biotech. 2018 doi: 10.1038/nbt.4172. In some embodiments, an NLS comprises the amino acid sequence KRTADGSEFESPKKKRKV (SEQ ID NO: 71), KRPAATKKAGQAKKKK (SEQ ID NO: 72), KKTELQTTNAENKTKKL (SEQ ID NO: 73), KRGINDRNFWRGENGRKTR (SEQ ID NO: 74), RKSGKIAAIVVKRPRK (SEQ ID NO: 75), PKKKRKV (SEQ ID NO: 76), or MDSLLMNRRKFLYQFKNVRWAKGRRETYLC (SEQ ID NO: 77).

The term "nucleobase", "nitrogenous base", or "base", used interchangeably herein, refers to a nitrogen-containing biological compound that forms a nucleoside, which, in turn, is a component of a nucleotide. The ability of nucleobases to form base pairs and to stack one upon another leads directly to long-chain helical structures such as ribonucleic acid (RNA) and deoxyribonucleic acid (DNA). Five nucleobases—adenine (A), cytosine (C), guanine (G), thymine (T), and uracil (U)—are called primary or canonical. Adenine and guanine are derived from purine, and cytosine, uracil, and thymine are derived from pyrimidine. DNA and RNA can also contain other (non-primary) bases that are modified. Non-limiting exemplary modified nucleobases can include hypoxanthine, xanthine, 7-methylguanine, 5,6-dihydrouracil, 5-methylcytosine (m5C), and 5-hydromethylcytosine. Hypoxanthine and xanthine can be created through mutagen presence, both of them through deamination (replacement of the amine group with a carbonyl group). Hypoxanthine can be modified from adenine. Xanthine can be modified from guanine. Uracil can result from deamination of cytosine. A "nucleoside" consists of a nucleobase and a five carbon sugar (either ribose or deoxyribose). Examples of a nucleoside include adenosine, guanosine, uridine, cytidine, 5-methyluridine (m5U), deoxyadenosine, deoxyguanosine, thymidine, deoxyuridine, and deoxycytidine. Examples of a nucleoside with a modified nucleobase includes inosine (I), xanthosine (X), 7-methylguanosine (m7G), dihydrouridine (D), 5-methylcytidine (m5C), and pseudouridine (P). A "nucleotide" consists of a nucleobase, a five carbon sugar (either ribose or deoxyribose), and at least one phosphate group.

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide", "polynucleotide", and "polynucleic acid" can be used interchangeably to refer to a polymer of nucleotides (e.g., a string of at least three nucleotides). In some embodiments, "nucleic acid" encompasses RNA as well as single and/or double-stranded DNA. Nucleic acids can be naturally occurring, for example, in the context of a genome, a transcript, mRNA, tRNA, rRNA, siRNA, snRNA, a plasmid, cosmid, chromosome, chromatid, or other naturally occurring nucleic acid molecules. On the other hand, a nucleic acid molecule can be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid", "DNA", "RNA", and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolopyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The term "nucleic acid programmable DNA binding protein" or "napDNAbp" may be used interchangably with "polynucleotide programmable nucleotide binding domain" to refer to a protein that associates with a nucleic acid (e.g., DNA or RNA), such as a guide nucleic acid, that guides the napDNAbp to a specific nucleic acid sequence. For example, a Cas9 protein can associate with a guide RNA that guides the Cas9 protein to a specific DNA sequence that is complementary to the guide RNA. In some embodiments, the napDNAbp is a Cas9 domain, for example, a nuclease active Cas9, a Cas9 nickase (nCas9), or a nuclease inactive Cas9 (dCas9). In some embodiments, the Cas9 domain comprises any one of the amino acid sequences as set forth herein. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

Examples of nucleic acid programmable DNA binding proteins include, without limitation, Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" *CRISPR J.* 2018 October; 1:325-336. doi: 10.1089/crispr.2018.0033; Yan et al., "Functionally diverse type V CRISPR-Cas systems" *Science.* 2019 Jan. 4; 363(6422):88-91. doi: 10.1126/science.aav7271, the entire contents of each are hereby incorporated by reference.

The terms "nucleobase editing domain" or "nucleobase editing protein", as used herein, refers to a protein or enzyme that can catalyze a nucleobase modification in RNA or DNA, such as cytosine (or cytidine) to uracil (or uridine) or thymine (or thymidine), and adenine (or adenosine) to hypoxanthine (or inosine) delaminations, as well as non-templated nucleotide additions and insertions. In some embodiments, the nucleobase editing domain is a deaminase domain (e.g., a cytidine deaminase, a cytosine deaminase, an adenine deaminase, or an adenosine deaminase). In some embodiments, the nucleobase editing domain can be a naturally occurring nucleobase editing domain. In some embodiments, the nucleobase editing domain can be an engineered or evolved nucleobase editing domain from the naturally occurring nucleobase editing domain. The nucleobase editing domain can be from any organism, such as a bacterium, human, chimpanzee, gorilla, monkey, cow, dog, rat, or mouse. For example, nucleobase editing proteins are described in International PCT Application Nos. PCT/2017/045381 (WO 2018/027078) and PCT/US2016/058344 (WO 2017/070632), each of which is incorporated herein by reference for its entirety. Also see, Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

As used herein, "obtaining" as in "obtaining an agent" includes synthesizing, purchasing, isolating, or otherwise acquiring the agent.

"Patient" or "subject" as used herein refers to a mammalian subject or individual diagnosed with, at risk of having or developing, or suspected of having or developing a disease or a disorder. In some embodiments, the term "patient" refers to a mammalian subject with a higher than average likelihood of developing a disease or a disorder. Exemplary patients can be humans, non-human primates, cats, dogs, pigs, cattle, cats, horses, camels, llamas, goats, sheep, rodents (e.g., mice, rabbits, rats, or guinea pigs) and other mammalians that can benefit from the therapies disclosed herein. Exemplary human patients can be male and/or female.

"Patient in need thereof" or "subject in need thereof" is referred to herein as a patient or subject diagnosed with, at risk of having, or suspected of having a disease or disorder, for instance, but not restricted to sickle cell disease (SCD) or alpha-1 antitrypsin Deficiency (A1AD), or a disease or disorder associated with the genes listed in Tables 3A, 3B, or 4 herein.

The terms "pathogenic mutation," "pathogenic variant," "disease causing (or disease-associated) mutation," "disease causing (or disease-associated) variant," "deleterious mutation," or "predisposing mutation" refer to a genetic alteration or mutation that increases an individual's susceptibility or predisposition to a certain disease or disorder. In some embodiments, the pathogenic mutation comprises at least one wild-type amino acid substituted by at least one pathogenic amino acid in a protein encoded by a gene.

The term "non-conservative mutations" refers to amino acid substitutions between different groups, for example, lysine for tryptophan, or phenylalanine for serine, etc. In this case, it is preferable for the non-conservative amino acid substitution to not interfere with, or inhibit the biological activity of, the functional variant. The non-conservative amino acid substitution can enhance the biological activity of the functional variant, such that the biological activity of the functional variant is increased as compared to the wild-type protein.

The terms "protein", "peptide", "polypeptide", and their grammatical equivalents are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide can refer to an individual protein or a collection of proteins. One or more of the amino acids in a protein, peptide, or polypeptide can be modified, for example, by the addition of a chemical entity such as a carbohydrate group, a hydroxyl group, a phosphate group, a farnesyl group, an isofarnesyl group, a fatty acid group, a linker for conjugation, functionalization, or other modifications, etc. A protein, peptide, or polypeptide can also be a single molecule or can be a multi-molecular complex. A protein, peptide, or polypeptide can be just a fragment of a naturally occurring protein or peptide. A protein, peptide, or polypeptide can be naturally occurring, recombinant, or synthetic, or any combination thereof. The term "fusion protein" as used herein refers to a hybrid polypeptide which comprises protein domains from at least two different proteins. One protein can be located at the amino-terminal (N-terminal) portion of the fusion protein or at the carboxy-terminal (C-terminal) protein thus forming an amino-terminal fusion protein or a carboxy-terminal fusion protein, respectively. A protein can comprise different domains, for example, a nucleic acid binding domain (e.g., the gRNA binding domain of Cas9 that directs the binding of the protein to a target site) and a nucleic acid cleavage domain, or a catalytic domain of a nucleic acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA or DNA. Any of the proteins provided herein can be produced by any method known in the art. For example, the proteins provided herein can be produced via recombinant protein expression and purification, which is especially suited for fusion proteins comprising a peptide linker. Methods for recombinant protein expression and purification are well known, and include those described by Green and Sambrook, Molecular Cloning: A Laboratory Manual (4th ed., Cold Spring Harbor Laboratory Press, Cold Spring Harbor, N.Y. (2012)), the entire contents of which are incorporated herein by reference.

Polypeptides and proteins disclosed herein (including functional portions and functional variants thereof) can comprise synthetic amino acids in place of one or more naturally-occurring amino acids. Such synthetic amino acids are known in the art, and include, for example, aminocyclohexane carboxylic acid, norleucine, α-amino n-decanoic acid, homoserine, S-acetylaminomethyl-cysteine, trans-3- and trans-4-hydroxyproline, 4-aminophenylalanine, 4-nitrophenylalanine, 4-chlorophenylalanine, 4-carboxyphenylalanine, β-phenylserine β-hydroxyphenylalanine, phenylglycine, α-naphthylalanine, cyclohexylalanine, cyclohexylglycine, indoline-2-carboxylic acid, 1,2,3,4-tetrahydroisoquinoline-3-carboxylic acid, aminomalonic acid, aminomalonic acid monoamide, N'-benzyl-N'-methyl-lysine, N',N'-dibenzyl-lysine, 6-hydroxylysine, ornithine, α-aminocyclopentane carboxylic acid, α-aminocyclohexane carboxylic acid, α-aminocycloheptane carboxylic acid, α-(2-amino-2-norbomane)-carboxylic acid, α,γ-diaminobutyric acid, α,β-diaminopropionic acid, homophenylalanine, and α-tert-butylglycine. The polypeptides and proteins can be associated with post-translational modifications of one or more amino acids of the polypeptide constructs. Non-limiting examples of post-translational modifications include phosphorylation, acylation including acetylation and formylation, glycosylation (including N-linked and O-linked), amidation, hydroxylation, alkylation including methylation and ethylation, ubiquitylation, addition of pyrrolidone carboxylic acid, formation of disulfide bridges, sulfation, myristoylation, palmitoylation, isoprenylation, farnesylation, geranylation, glypiation, lipoylation and iodination.

The term "gene" as used herein refers to a polynucleotide that typically comprises a protein coding region and a protein non-coding region. The protein non-coding region can comprise one or more regulatory elements. Non-limiting examples of the regulatory elements comprise a promoter, an enhancer, a repressor, a silencer, an insulator, a start codon, a stop codon, Kozak consensus sequence, a slice acceptor, a splice donor, 3' and/or 5' untranslated region (UTR), a slice site, or an intergenic region. In some embodiments, the regulatory element is located in a gene that is the cause of a genetic disease or disorder. Non-limiting examples of the regulator element located in a gene that is the cause of a genetic disease or disorder include a start codon, a stop codon, Kozak consensus sequence, an intergenic region, 3' UTR, or 5' UTR etc. In some embodiments, the regulatory element is not located in a gene that is the cause of a genetic disease or disorder. Non-limiting examples of the regulatory element that is not located in a gene that is the cause of a genetic disorder include an enhancer, a repressor, or an insulator etc.

The term "polynucleotide programmable nucleotide binding domain" refers to a protein that associates with a nucleic acid (e.g., DNA or RNA), such as a guide polynucleotide (e.g., guide RNA), that guides the polynucleotide programmable DNA binding domain to a specific nucleic acid sequence. In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the polynucleotide programmable nucleotide binding domain is a Cas9 protein. A Cas9 protein can associate with a guide RNA that guides the Cas9 protein to a specific DNA sequence that has complementary to the guide RNA. In some embodiments, the polynucleotide programmable nucleotide binding domain is a Cas9 domain, for example a nuclease active Cas9, a Cas9 nickase (nCas9), or a nuclease inactive Cas9 (dCas9). Non-limiting examples of nucleic acid programmable DNA binding proteins include Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, though they are not specifically listed in this disclosure.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

By "reduces" is meant a negative alteration of at least 10%, 25%, 50%, 75%, or 100%.

By "reference" is meant a standard or control condition. By way of nonlimiting example, an assay for the activity or function of a gene (and/or its encoded protein product) following base editing, e.g., benign or regulatory base editing, as described herein is compared with the activity or function of the gene (and/or its encoded product) in which benign or regulatory base editing did not occur, or with the activity or function of a wild type gene (and/or its encoded product) as a reference. In one embodiment, the reference is a wild-type or healthy cell.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 16 amino acids, preferably at least about 20 amino acids, more preferably at least about 25 amino acids, and even more preferably about 35 amino acids, about 50 amino acids, or about 100 amino acids. For nucleic acids, the length of the reference nucleic acid sequence will generally be at least about 50 nucleotides, preferably at least about 60 nucleotides, more preferably at least about 75 nucleotides, and even more preferably about 100 nucleotides or about 300 nucleotides or any integer thereabout or therebetween.

The term "RNA-programmable nuclease," and "RNA-guided nuclease" are used with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). Guide RNAs (gRNAs) can exist as a complex of two or more RNAs, or as a single RNA molecule. gRNAs that exist as a single RNA molecule may be referred to as single-guide RNAs (sgRNAs), although "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., Science 337:816-821 (2012), the entire contents of which is incorporated herein by reference. Other examples of gRNAs (e.g., those including domain 2) can be found in U.S. Provisional Patent Application No. 61/874,682, filed Sep. 6, 2013, entitled "Switchable Cas9 Nucleases and Uses Thereof," and U.S. Provisional Patent Application No. 61/874,746, filed Sep. 6, 2013, entitled "Delivery System for Functional Nucleases," the entire contents of each are hereby incorporated by reference. In some embodiments, a gRNA comprises two or more of domains (1) and (2), and may be referred to as an "extended gRNA." For example, an extended gRNA will bind two or more Cas9 proteins and will bind a target nucleic acid at two or more distinct regions, as described herein. The gRNA comprises a nucleotide sequence that complements a target site, which mediates binding of the nuclease/RNA complex to the target site, providing the sequence specificity of the nuclease:RNA complex. In some embodiments, the RNA-programmable nuclease is the (CRISPR-associated system) Cas9 endonuclease, for example, Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C, Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C M., Gonzales K., Chao Y., Pirzada Z. A., Eckert M. R., Vogel J., Charpentier E., Nature 471:602-607(2011).

The term "single nucleotide polymorphism (SNP)" is a variation in a single nucleotide that occurs at a specific position in the genome, where each variation is present to some appreciable degree within a population (e.g. >1%). For example, at a specific base position in the human genome, the C nucleotide can appear in most individuals, but in a minority of individuals, the position is occupied by an A. This means that there is a SNP at this specific position, and the two possible nucleotide variations, C or A, are the to be alleles for this position. SNPs underlie differences in susceptibility to disease. The severity of illness and the way our body responds to treatments are also manifestations of genetic variations. SNPs can fall within coding regions of genes, non-coding regions of genes, or in the intergenic regions (regions between genes). In some embodiments, SNPs within a coding sequence do not necessarily change the amino acid sequence of the protein that is produced, due to degeneracy of the genetic code. SNPs in the coding region are of two types: synonymous and nonsynonymous SNPs. Synonymous SNPs do not affect the protein sequence, while nonsynonymous SNPs change the amino acid sequence of protein. The nonsynonymous SNPs are of two types: missense and nonsense. SNPs that are not in protein-coding regions can still affect gene splicing, transcription factor binding, messenger RNA degradation, or the sequence of noncoding RNA. Gene expression affected by this type of SNP is referred to as an eSNP (expression SNP) and can be upstream or downstream from the gene. A single nucleotide variant (SNV) is a variation in a single nucleotide without any limitations of frequency and can arise in somatic cells. A somatic single nucleotide variation (e.g., caused by cancer) can also be called a single-nucleotide alteration.

By "specifically binds" is meant a nucleic acid molecule, polypeptide, or complex thereof (e.g., a nucleic acid programmable DNA binding domain and guide nucleic acid), compound, or molecule that recognizes and binds a polypeptide and/or nucleic acid molecule of the invention, but which does not substantially recognize and bind other molecules in a sample, for example, a biological sample.

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In an embodiment, hybridization occurs at 30° C. in 750 mM NaCl, 75 mM trisodium citrate, and 1% SDS. In another embodiment, hybridization occurs at 37° C. in 500 mM NaCl, 50 mM trisodium citrate, 1% SDS, 35% formamide, and 100 μg/ml denatured salmon sperm DNA (ssDNA). In another embodiment, hybridization occurs at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will be less than about 30 mM NaCl and 3 mM trisodium citrate, and may be less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In a preferred embodiment, wash steps occur at 25° C. in 30 mM NaCl, 3 mM trisodium citrate, and 0.1% SDS. In a more preferred embodiment, wash steps occur at 42 C in 15 mM NaCl, 1.5 mM trisodium citrate, and 0.1% SDS. In a more preferred embodiment, wash steps occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196:180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). Preferably, such a sequence is at least 60%, more preferably 80% or 85%, and more preferably 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, COBALT, EMBOSS Needle, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence. COBALT is used, for example, with the following parameters:
 a) alignment parameters: Gap penalties-11,-1 and End-Gap penalties-5,-1,
 b) CDD Parameters: Use RPS BLAST on; Blast E-value 0.003; Find Conserved columns and Recompute on, and
 c) Query Clustering Parameters: Use query clusters on; Word Size 4; Max cluster distance 0.8; Alphabet Regular.

EMBOSS Needle is used, for example, with the following parameters:
 a) Matrix: BLOSUM62;
 b) GAP OPEN: 10;
 c) GAP EXTEND: 0.5;
 d) OUTPUT FORMAT: pair;
 e) END GAP PENALTY: false;
 f) END GAP OPEN: 10; and
 g) END GAP EXTEND: 0.5.

By "subject" is meant a mammal, including, but not limited to, a human or non-human mammal, such as a bovine, equine, canine, ovine, or feline.

The term "target site" refers to a sequence within a nucleic acid molecule that is modified by a nucleobase editor. In one embodiment, the target site is deaminated by a deaminase or a fusion protein comprising a deaminase (e.g., a cytidine or an adenine deaminase).

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al., Multiplex genome engineering using CRISPR/Cas systems. Science 339, 819-823 (2013); *Mali*, P. et al., RNA-guided human genome engineering via Cas9. Science 339, 823-826 (2013); Hwang, W. Y. et al., Efficient genome editing in zebrafish using a CRISPR-Cas system. Nature biotechnology 31, 227-229 (2013); Jinek, M. et al., RNA-programmed genome editing in human cells. eLife 2, e00471 (2013); Dicarlo, J. E. et al., Genome engineering in *Saccharomyces cerevisiae* using CRISPR-Cas systems. Nucleic acids research (2013); Jiang, W. et al., RNA-guided editing of bacterial genomes using CRISPR-Cas systems. Nature biotechnology 31, 233-239 (2013), the entire contents of each of which are incorporated herein by reference).

As used herein, the terms "treat," treating," "treatment," and the like refer to reducing or ameliorating a disease or disorder and/or symptoms associated therewith or obtaining a desired pharmacologic and/or physiologic effect. It will be appreciated that, although not precluded, treating a disorder or condition does not require that the disorder, condition or symptoms associated therewith be completely eliminated. In some embodiments, the effect is therapeutic, i.e., without limitation, the effect partially or completely reduces, diminishes, abrogates, abates, alleviates, decreases the intensity of, or cures a disease or disorder and/or adverse symptom attributable to the disease or disorder. In some embodiments, the effect is preventative, i.e., the effect protects or prevents an occurrence or reoccurrence of a disease, disorder, or condition. To this end, the presently disclosed methods comprise administering a therapeutically effective amount of a compositions as described herein.

By "uracil glycosylase inhibitor" is meant an agent that inhibits the uracil-excision repair system. In one embodiment, the agent is a protein or fragment thereof that binds a host uracil-DNA glycosylase and prevents removal of uracil residues from DNA.

Ranges provided herein are understood to be shorthand for all of the values within the range, inclusive of the first and last values, as well as values therebetween. For example, a range of 1 to 50 is understood to include any number, combination of numbers, or sub-range from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof.

Any compositions or methods provided herein can be combined with one or more of any of the other compositions and methods provided herein.

DNA editing has emerged as a viable means to modify disease states by correcting pathogenic mutations at the genetic level. Until recently, all DNA editing platforms have functioned by inducing a DNA double strand break (DSB) at a specified genomic site and have relied on endogenous DNA repair pathways to determine the product outcome in a semi-stochastic manner, resulting in complex populations of genetic products. Though precise, user-defined repair outcomes can be achieved through the homology directed repair (HDR) pathway, a number of challenges have prevented high efficiency repair using HDR in therapeutically-relevant cell types. In practice, this pathway is inefficient relative to the competing, error-prone non-homologous end joining pathway. Further, HDR is tightly restricted to the G1 and S phases of the cell cycle, preventing precise repair of DSBs in post-mitotic cells. As a result, it has proven difficult or impossible to alter genomic sequences in a user-defined, programmable manner with high efficiencies in these populations Nucleobase Editor Disclosed herein is a base editor or a nucleobase editor for editing, modifying or altering a target nucleotide sequence of a polynucleotide. Described herein is a nucleobase editor or a base editor comprising a polynucleotide programmable nucleotide binding domain and a nucleobase editing domain. A polynucleotide programmable nucleotide binding domain, when in conjunction with a bound guide polynucleotide (e.g., gRNA), can specifically bind to a target polynucleotide sequence (i.e., via complementary base pairing between bases of the bound guide nucleic acid and bases of the target polynucleotide sequence) and thereby localize the base editor to the target nucleic acid sequence desired to be edited. In some embodiments, the target polynucleotide sequence comprises single-stranded DNA or double-stranded DNA. In some embodiments, the target polynucleotide sequence comprises RNA. In some embodiments, the target polynucleotide sequence comprises a DNA-RNA hybrid.

Polynucleotide Programmable Nucleotide Binding Domain

The term "polynucleotide programmable nucleotide binding domain" or "nucleic acid programmable DNA binding protein (napDNAbp)" refers to a protein that associates with a nucleic acid (e.g., DNA or RNA), such as a guide polynucleotide (e.g., guide RNA), that guides the polynucleotide programmable nucleotide binding domain to a specific nucleic acid sequence. In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the polynucleotide programmable nucleotide binding domain is a Cas9 protein. In some embodiments, the polynucleotide programmable nucleotide binding domain is a Cpf1 protein.

CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, and then trimmed 3'-5' exonucleolytically. In nature, DNA-binding and cleavage typically requires protein and both RNAs. However, single guide RNAs ("sgRNA", or simply "gRNA") can be engineered so as to incorporate aspects of both the crRNA and tracrRNA into a single RNA species. See, e.g., Jinek M., Chylinski K., Fonfara I., Hauer M., Doudna J. A., Charpentier E. Science 337:816-821 (2012), the entire contents of which is hereby incorporated by reference. Cas9 recognizes a short motif in the CRISPR repeat sequences (the PAM or protospacer adjacent motif) to help distinguish "self" from "non-self".

Cas9 Domains of Nucleobase Editors

Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C, Sezate S., Suvorov A. N., Kenton S., Lai H. S., Lin S. P., Qian Y., Jia H. G., Najar F. Z., Ren Q., Zhu H., Song L., Natl. Acad. Sci. U.S.A. 98:4658-4663(2001); "CRISPR RNA maturation by trans-encoded small RNA and host factor RNase III." Deltcheva E., Chylinski K., Sharma C M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences can be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

In some embodiments, a Cas9 nuclease has an inactive (e.g., an inactivated) DNA cleavage domain, that is, the Cas9 is a nickase, referred to as an "nCas9" protein (for "nickase" Cas9). A nuclease-inactivated Cas9 protein can interchangeably be referred to as a "dCas9" protein (for nuclease-dead Cas9). Methods for generating a Cas9 protein (or a fragment thereof) having an inactive DNA cleavage domain are known (See, e.g., Jinek et al, Science. 337:816-821(2012); Qi et al, "Repurposing CRISPR as an RNA-Guided Platform for Sequence-Specific Control of Gene Expression" (2013) Cell. 28; 152(5): 1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al, Science. 337:816-821(2012); Qi et al, Cell. 28; 152(5): 1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, wild type Cas9 corresponds to Cas9 from *Streptococcus pyogenes* (NCBI Reference Sequence: NC_017053.1, nucleotide and amino acid sequences as follows):

(SEQ ID NO: 78)

```
ATGGATAAGAAATACTCAATAGGCTTAGATATCGGCACAAATAGCGTCGGATGGGCGGTGATCA

CTGATGATTATAAGGTTCCGTCTAAAAAGTTCAAGGTTCTGGGAAATACAGACCGCCACAGTAT

CAAAAAAAATCTTATAGGGGCTCTTTTATTTGGCAGTGGAGAGACAGCGGAAGCGACTCGTCTC

AAACGGACAGCTCGTAGAAGGTATACACGTCGGAAGAATCGTATTTGTTATCTACAGGAGATTT

TTTCAAATGAGATGGCGAAAGTAGATGATAGTTTCTTTCATCGACTTGAAGAGTCTTTTTTGGT

GGAAGAAGACAAGAAGCATGAACGTCATCCTATTTTTGGAAATATAGTAGATGAAGTTGCTTAT

CATGAGAAATATCCAACTATCTATCATCTGCGAAAAAAATTGGCAGATTCTACTGATAAAGCGG

ATTTGCGCTTAATCTATTTGGCCTTAGCGCATATGATTAAGTTTCGTGGTCATTTTTTGATTGA

GGGAGATTTAAATCCTGATAATAGTGATGTGGACAAACTATTTATCCAGTTGGTACAAATCTAC

AATCAATTATTTGAAGAAAACCCTATTAACGCAAGTAGAGTAGATGCTAAAGCGATTCTTTCTG

CACGATTGAGTAAATCAAGACGATTAGAAAATCTCATTGCTCAGCTCCCCGGTGAGAAGAGAAA

TGGCTTGTTTGGGAATCTCATTGCTTTGTCATTGGGATTGACCCCTAATTTTAAATCAAATTTT

GATTTGGCAGAAGATGCTAAATTACAGCTTTCAAAAGATACTTACGATGATGATTTAGATAATT

TATTGGCGCAAATTGGAGATCAATATGCTGATTTGTTTTTGGCAGCTAAGAATTTATCAGATGC

TATTTTACTTTCAGATATCCTAAGAGTAAATAGTGAAATAACTAAGGCTCCCCTATCAGCTTCA

ATGATTAAGCGCTACGATGAACATCATCAAGACTTGACTCTTTTAAAAGCTTTAGTTCGACAAC

AACTTCCAGAAAAGTATAAAGAAATCTTTTTTGATCAATCAAAAAACGGATATGCAGGTTATAT

TGATGGGGGAGCTAGCCAAGAAGAATTTTATAAATTTATCAAACCAATTTTAGAAAAAATGGAT

GGTACTGAGGAATTATTGGTGAAACTAAATCGTGAAGATTTGCTGCGCAAGCAACGGACCTTTG

ACAACGGCTCTATTCCCCATCAAATTCACTTGGGTGAGCTGCATGCTATTTTGAAGAAGACAAGA

AGACTTTTATCCATTTTTAAAAGACAATCGTGAGAAGATTGAAAAAATCTTGACTTTTCGAATT

CCTTATTATGTTGGTCCATTGGCGCGTGGCAATAGTCGTTTTGCATGGATGACTCGGAAGTCTG

AAGAAACAATTACCCCATGGAATTTTGAAGAAGTTGTCGATAAAGGTGCTTCAGCTCAATCATT

TATTGAACGCATGACAAACTTTGATAAAAATCTTCCAAATGAAAAAGTACTACCAAAACATAGT
```

-continued

```
TTGCTTTATGAGTATTTTACGGTTTATAACGAATTGACAAAGGTCAAATATGTTACTGAGGGAA
TGCGAAAACCAGCATTTCTTTCAGGTGAACAGAAGAAAGCCATTGTTGATTTACTCTTCAAAAC
AAATCGAAAAGTAACCGTTAAGCAATTAAAAGAAGATTATTTCAAAAAAATAGAATGTTTTGAT
AGTGTTGAAATTTCAGGAGTTGAAGATAGATTTAATGCTTCATTAGGCGCCTACCATGATTTGC
TAAAAATTATTAAAGATAAAGATTTTTTGGATAATGAAGAAAATGAAGATATCTTAGAGGATAT
TGTTTTAACATTGACCTTATTTGAAGATAGGGGGATGATTGAGGAAAGACTTAAAACATATGCT
CACCTCTTTGATGATAAGGTGATGAAACAGCTTAAACGTCGCCGTTATACTGGTTGGGGACGTT
TGTCTCGAAAATTGATTAATGGTATTAGGGATAAGCAATCTGGCAAAACAATATTAGATTTTTT
GAAATCAGATGGTTTTGCCAATCGCAATTTTATGCAGCTGATCCATGATGATAGTTTGACATTT
AAAGAAGATATTCAAAAAGCACAGGTGTCTGGACAAGGCCATAGTTTACATGAACAGATTGCTA
ACTTAGCTGGCAGTCCTGCTATTAAAAAAGGTATTTTACAGACTGTAAAAATTGTTGATGAACT
GGTCAAAGTAATGGGGCATAAGCCAGAAAATATCGTTATTGAAATGGCACGTGAAAATCAGACA
ACTCAAAAGGGCCAGAAAAATTCGCGAGAGCGTATGAAACGAATCGAAGAAGGTATCAAAGAAT
TAGGAAGTCAGATTCTTAAAGAGCATCCTGTTGAAAATACTCAATTGCAAAATGAAAAGCTCTA
TCTCTATTATCTACAAAATGGAAGAGACATGTATGTGGACCAAGAATTAGATATTAATCGTTTA
AGTGATTATGATGTCGATCACATTGTTCCACAAAGTTTCATTAAAGACGATTCAATAGACAATA
AGGTACTAACGCGTTCTGATAAAAATCGTGGTAAATCGGATAACGTTCCAAGTGAAGAAGTAGT
CAAAAAGATGAAAAACTATTGGAGACAACTTCTAAACGCCAAGTTAATCACTCAACGTAAGTTT
GATAATTTAACGAAAGCTGAACGTGGAGGTTTGAGTGAACTTGATAAAGCTGGTTTTATCAAAC
GCCAATTGGTTGAAACTCGCCAAATCACTAAGCATGTGGCACAAATTTTGGATAGTCGCATGAA
TACTAAATACGATGAAAATGATAAACTTATTCGAGAGGTTAAAGTGATTACCTTAAAATCTAAA
TTAGTTTCTGACTTCCGAAAAGATTTCCAATTCTATAAAGTACGTGAGATTAACAATTACCATC
ATGCCCATGATGCGTATCTAAATGCCGTCGTTGGAACTGCTTTGATTAAGAAATATCCAAAACT
TGAATCGGAGTTTGTCTATGGTGATTATAAAGTTTATGATGTTCGTAAAATGATTGCTAAGTCT
GAGCAAGAAATAGGCAAAGCAACCGCAAAATATTTCTTTTACTCTAATATCATGAACTTCTTCA
AAACAGAAATTACACTTGCAAATGGAGAGATTCGCAAACGCCCTCTAATCGAAACTAATGGGGA
AACTGGAGAAATTGTCTGGGATAAAGGGCGAGATTTTGCCACAGTGCGCAAAGTATTGTCCATG
CCCCAAGTCAATATTGTCAAGAAAACAGAAGTACAGACAGGCGGATTCTCCAAGGAGTCAATTT
TACCAAAAAGAAATTCGGACAAGCTTATTGCTCGTAAAAAAGACTGGGATCCAAAAAAATATGG
TGGTTTTGATAGTCCAACGGTAGCTTATTCAGTCCTAGTGGTTGCTAAGGTGGAAAAAGGGAAA
TCGAAGAAGTTAAAATCCGTTAAAGAGTTACTAGGGATCACAATTATGGAAAGAAGTTCCTTTG
AAAAAAATCCGATTGACTTTTTAGAAGCTAAAGGATATAAGGAAGTTAAAAAAGACTTAATCAT
TAAACTACCTAAATATAGTCTTTTTGAGTTAGAAAACGGTCGTAAACGGATGCTGGCTAGTGCC
GGAGAATTACAAAAAGGAAATGAGCTGGCTCTGCCAAGCAAATATGTGAATTTTTTATATTTAG
CTAGTCATTATGAAAAGTIGAAGGGTAGTCCAGAAGATAACGAACAAAAACAATTGTTTGTGGA
GCAGCATAAGCATTATTTAGATGAGATTATTGAGCAAATCAGTGAATTTTCTAAGCGTGTTATT
TTAGCAGATGCCAATTTAGATAAAGTTCTTAGTGCATATAACAAACATAGAGACAAACCAATAC
GTGAACAAGCAGAAAATATTATTCATTTATTTACGTTGACGAATCTTGGAGCTCCCGCTGCTTT
TAAATATTTTGATACAACAATTGATCGTAAACGATATACGTCTACAAAAGAAGTTTTAGATGCC
ACTCTTATCCATCAATCCATCACTGGTCTTTATGAAACACGCATTGATTTGAGTCAGCTAGGAG
GTGACTGA.
```

-continued (SEQ ID NO: 47)
MDKKYSIGLDIGTNSVGWAVITDDYKVPSKKFKVLGNTDRHSIKKNLIGALLFGSGETAEATRL

KRTARRRYTRRKNRICYLQEIFSNEMAKVDDSFFHRLEESFLVEEDKKHERHPIFGNIVDEVAY

HEKYPTIYHLRKKLADSTDKADLRLIYLALAHMIKFRGHFLIEGDLNPDNSDVDKLFIQLVQIY

NQLFEENPINASRVDAKAILSARLSKSRRLENLIAQLPGEKRNGLFGNLIALSLGLTPNFKSNF

DLAEDAKLQLSKDTYDDDLDNLLAQIGDQYADLFLAAKNLSDAILLSDILRVNSEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGAYHDLLKIIKDKDFLDNEENEDILEDIVLTLTLFEDRGMIEERLKTYA

HLFDDKVMKQLKRRRYTGWGRLSRKLINGIRDKQSGKTILDFLKSDGFANRNFMQLIHDDSLTF

KEDIQKAQVSGQGHSLHEQIANLAGSPAIKKGILQTVKIVDELVKVMGHKPENIVIEMARENQT

TQKGQKNSRERMKRIEEGIKELGSQILKEHPVENTQLQNEKLYLYYLQNGRDMYVDQELDINRL

SDYDVDHIVPQSFIKDDSIDNKVLTRSDKNRGKSDNVPSEEVVKKMKNYWRQLLNAKLITQRKF

DNLTKAERGGLSELDKAGFIKRQLVETRQITKHVAQILDSRMNTKYDENDKLIREVKVITLKSK

LVSDFRKDFQFYKVREINNYHHAHDAYLNAVVGTALIKKYPKLESEFVYGDYKVYDVRKMIAKS

EQEIGKATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVVAKVEKGK

SKKLKSVKELLGITIMERSSFEKNPIDFLEAKGYKEVKKDLIIKLPKYSLFELENGRKRMLASA

GELQKGNELALPSKYVNFLYLASHYEKLKGSPEDNEQKQLFVEQHKHYLDEIIEQISEFSKRVI

LADANLDKVLSAYNKHRDKPIREQAENIIHLFTLTNLGAPAAFKYFDTTIDRKRYTSTKEVLDA

TLIHQSITGLYETRIDLSQLGGD
(single underline: HNH domain; double underline: RuvC domain).

In some embodiments, wild type Cas9 corresponds to, or comprises the following nucleotide and/or amino acid sequences:

(SEQ ID NO: 79)
ATGGATAAAAAGTATTCTATTGGTTTAGACATCGGCACTAATTCCGTTGGATGGGCTGTCATAA

CCGATGAATACAAAGTACCTTCAAAGAAATTTAAGGTGTTGGGGAACACAGACCGTCATTCGAT

TAAAAAGAATCTTATCGGTGCCCTCCTATTCGATAGTGGCGAAACGGCAGAGGCGACTCGCCTG

AAACGAACCGCTCGGAGAAGGTATACACGTCGCAAGAACCGAATATGTTACTTACAAGAAATTT

TTAGCAATGAGATGGCCAAAGTTGACGATTCTTTCTTTCACCGTTTGGAAGAGTCCTTCCTTGT

CGAAGAGGACAAGAAACATGAACGGCACCCCATCTTTGGAAACATAGTAGATGAGGTGGCATAT

CATGAAAAGTACCCAACGATTTATCACCTCAGAAAAAAGCTAGTTGACTCAACTGATAAAGCGG

ACCTGAGGTTAATCTACTTGGCTCTTGCCCATATGATAAAGTTCCGTGGGCACTTTCTCATTGA

GGGTGATCTAAATCCGGACAACTCGGATGTCGACAAACTGTTCATCCAGTTAGTACAAACCTAT

AATCAGTTGTTTGAAGAGAACCCTATAAATGCAAGTGGCGTGGATGCGAAGGCTATTCTTAGCG

CCCGCCTCTCTAAATCCCGACGGCTAGAAAACCTGATCGCACAATTACCCGGAGAGAAGAAAA

TGGGTTGTTCGGTAACCTTATAGCGCTCTCACTAGGCCTGACACCAAATTTTAAGTCGAACTTC

GACTTAGCTGAAGATGCCAAATTGCAGCTTAGTAAGGACACGTACGATGACGATCTCGACAATC

-continued

```
TACTGGCACAAATTGGAGATCAGTATGCGGACTTATTTTTGGCTGCCAAAAACCTTAGCGATGC
AATCCTCCTATCTGACATACTGAGAGTTAATACTGAGATTACCAAGGCGCCGTTATCCGCTTCA
ATGATCAAAAGGTACGATGAACATCACCAAGACTTGACACTTCTCAAGGCCCTAGTCCGTCAGC
AACTGCCTGAGAAATATAAGGAAATATTCTTTGATCAGTCGAAAAACGGGTACGCAGGTTATAT
TGACGGCGGAGCGAGTCAAGAGGAATTCTACAAGTTTATCAAACCCATATTAGAGAAGATGGAT
GGGACGGAAGAGTTGCTTGTAAAACTCAATCGCGAAGATCTACTGCGAAAGCAGCGGACTTTCG
ACAACGGTAGCATTCCACATCAAATCCACTTAGGCGAATTGCATGCTATACTTAGAAGGCAGGA
GGATTTTTATCCGTTCCTCAAAGACAATCGTGAAAAGATTGAGAAAATCCTAACCTTTCGCATA
CCTTACTATGTGGGACCCCTGGCCCGAGGGAACTCTCGGTTCGCATGGATGACAAGAAAGTCCG
AAGAAACGATTACTCCATGGAATTTTGAGGAAGTTGTCGATAAAGGTGCGTCAGCTCAATCGTT
CATCGAGAGGATGACCAACTTTGACAAGAATTTACCGAACGAAAAGTATTGCCTAAGCACAGT
TTACTTTACGAGTATTTCACAGTGTACAATGAACTCACGAAAGTTAAGTATGTCACTGAGGGCA
TGCGTAAACCCGCCTTTCTAAGCGGAGAACAGAAGAAAGCAATAGTAGATCTGTTATTCAAGAC
CAACCGCAAAGTGACAGTTAAGCAATTGAAAGAGGACTACTTTAAGAAAATTGAATGCTTCGAT
TCTGTCGAGATCTCCGGGGTAGAAGATCGATTTAATGCGTCACTTGGTACGTATCATGACCTCC
TAAAGATAATTAAAGATAAGGACTTCCTGGATAACGAAGAGAATGAAGATATCTTAGAAGATAT
AGTGTTGACTCTTACCCTCTTTGAAGATCGGGAAATGATTGAGGAAAGACTAAAAACATACGCT
CACCTGTTCGACGATAAGGTTATGAAACAGTTAAAGAGGCGTCGCTATACGGGCTGGGGACGAT
TGTCGCGGAAACTTATCAACGGGATAAGAGACAAGCAAAGTGGTAAAACTATTCTCGATTTTCT
AAAGAGCGACGGCTTCGCCAATAGGAACTTTATGCAGCTGATCCATGATGACTCTTTAACCTTC
AAAGAGGATATACAAAAGGCACAGGTTTCCGGACAAGGGGACTCATTGCACGAACATATTGCGA
ATCTTGCTGGTTCGCCAGCCATCAAAAAGGGCATACTCCAGACAGTCAAAGTAGTGGATGAGCT
AGTTAAGGTCATGGGACGTCACAAACCGGAAAACATTGTAATCGAGATGGCACGCGAAAATCAA
ACGACTCAGAAGGGGCAAAAAAACAGTCGAGAGCGGATGAAGAGAATAGAAGAGGGTATTAAAG
AACTGGGCAGCCAGATCTTAAAGGAGCATCCTGTGGAAAATACCCAATTGCAGAACGAGAAACT
TTACCTCTATTACCTACAAAATGGAAGGGACATGTATGTTGATCAGGAACTGGACATAAACCGT
TTATCTGATTACGACGTCGATCACATTGTACCCCAATCCTTTTTGAAGGACGATTCAATCGACA
ATAAAGTGCTTACACGCTCGGATAAGAACCGAGGGAAAAGTGACAATGTTCCAAGCGAGGAAGT
CGTAAAGAAAATGAAGAACTATTGGCGGCAGCTCCTAAATGCGAAACTGATAACGCAAAGAAAG
TTCGATAACTTAACTAAAGCTGAGAGGGGTGGCTTGTCTGAACTTGACAAGGCCGGATTTATTA
AACGTCAGCTCGTGGAAACCCGCCAAATCACAAAGCATGTTGCACAGATACTAGATTCCCGAAT
GAATACGAAATACGACGAGAACGATAAGCTGATTCGGGAAGTCAAAGTAATCACTTTAAAGTCA
AAATTGGTGTCGGACTTCAGAAAGGATTTTCAATTCTATAAAGTTAGGGAGATAAATAACTACC
ACCATGCGCACGACGCTTATCTTAATGCCGTCGTAGGGACCGCACTCATTAAGAAATACCCGAA
GCTAGAAAGTGAGTTTGTGTATGGTGATTACAAAGTTTATGACGTCCGTAAGATGATCGCGAAA
AGCGAACAGGAGATAGGCAAGGCTACAGCCAAATACTTCTTTTATTCTAACATTATGAATTTCT
TTAAGACGGAAATCACTCTGGCAAACGGAGAGATACGCAAACGACCTTTAATTGAAACCAATGG
GGAGACAGGTGAAATCGTATGGGATAAGGGCCGGGACTTCGCGACGGTGAGAAAAGTTTTGTCC
ATGCCCCAAGTCAACATAGTAAAGAAAACTGAGGTGCAGACCGGAGGGTTTTCAAAGGAATCGA
TTCTTCCAAAAAGGAATAGTGATAAGCTCATCGCTCGTAAAAAGGACTGGGACCCGAAAAAGTA
CGGTGGCTTCGATAGCCCTACAGTTGCCTATTCTGTCCTAGTAGTGGCAAAAGTTGAGAAGGGA
```

-continued

AAATCCAAGAAACTGAAGTCAGTCAAAGAATTATTGGGGATAACGATTATGGAGCGCTCGTCTT

TTGAAAAGAACCCCATCGACTTCCTTGAGGCGAAAGGTTACAAGGAAGTAAAAAAGGATCTCAT

AATTAAACTACCAAAGTATAGTCTGTTTGAGTTAGAAAATGGCCGAAAACGGATGTTGGCTAGC

GCCGGAGAGCTTCAAAAGGGGAACGAACTCGCACTACCGTCTAAATACGTGAATTTCCTGTATT

TAGCGTCCCATTACGAGAAGTTGAAAGGTTCACCTGAAGATAACGAACAGAAGCAACTTTTTGT

TGAGCAGCACAAACATTATCTCGACGAAATCATAGAGCAAATTTCGGAATTCAGTAAGAGAGTC

ATCCTAGCTGATGCCAATCTGGACAAAGTATTAAGCGCATACAACAAGCACAGGGATAAACCCA

TACGTGAGCAGGCGGAAAATATTATCCATTTGTTTACTCTTACCAACCTCGGCGCTCCAGCCGC

ATTCAAGTATTTTGACACAACGATAGATCGCAAACGATACACTTCTACCAAGGAGGTGCTAGAC

GCGACACTGATTCACCAATCCATCACGGGATTATATGAAACTCGGATAGATTTGTCACAGCTTG

GGGGTGACGGATCCCCCAAGAAGAAGAGGAAAGTCTCGAGCGACTACAAAGACCATGACGGTGA

TTATAAAGATCATGACATCGATTACAAGGATGACGATGACAAGGCTGCAGGA (SEQ ID NO: 80)
MDKK<u>YSIGLAIGTNSVGWAVITDEYKVPSKKFKVLGNTDRHSIKKNLIGALLFDSGETA</u>EATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQG<u>DSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG</u>

KSKKLKSVKELLGITIMERSSFEKNPIDFLEAKGYKEVKKDLIIKLPKYSLFELENGRKRMLAS

-continued

```
AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD
(single underline: HNH domain; double underline: RuvC domain).
```

In some embodiments, wild type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows).

```
                                                       (SEQ ID NO: 81)
ATGGATAAGAAATACTCAATAGGCTTAGATATCGGCACAAATAGCGTCGGATGGGCGGTGATCA

CTGATGAATATAAGGTTCCGTCTAAAAAGTTCAAGGTTCTGGGAAATACAGACCGCCACAGTAT

CAAAAAAATCTTATAGGGGCTCTTTTATTTGACAGTGGAGAGACAGCGGAAGCGACTCGTCTC

AAACGGACAGCTCGTAGAAGGTATACACGTCGGAAGAATCGTATTTGTTATCTACAGGAGATTT

TTTCAAATGAGATGGCGAAAGTAGATGATAGTTTCTTTCATCGACTTGAAGAGTCTTTTTTGGT

GGAAGAAGACAAGAAGCATGAACGTCATCCTATTTTTGGAAATATAGTAGATGAAGTTGCTTAT

CATGAGAAATATCCAACTATCTATCATCTGCGAAAAAATTGGTAGATTCTACTGATAAAGCGG

ATTTGCGCTTAATCTATTTGGCCTTAGCGCATATGATTAAGTTTCGTGGTCATTTTTTGATTGA

GGGAGATTTAAATCCTGATAATAGTGATGTGGACAAACTATTTATCCAGTTGGTACAAACCTAC

AATCAATTATTTGAAGAAAACCCTATTAACGCAAGTGGAGTAGATGCTAAAGCGATTCTTTCTG

CACGATTGAGTAAATCAAGACGATTAGAAAATCTCATTGCTCAGCTCCCCGGTGAGAAGAAAA

TGGCTTATTTGGGAATCTCATTGCTTTGTCATTGGGTTTGACCCCTAATTTTAAATCAAATTTT

GATTTGGCAGAAGATGCTAAATTACAGCTTTCAAAAGATACTTACGATGATGATTTAGATAATT

TATTGGCGCAAATTGGAGATCAATATGCTGATTTGTTTTTGGCAGCTAAGAATTTATCAGATGC

TATTTTACTTTCAGATATCCTAAGAGTAAATACTGAAATAACTAAGGCTCCCCTATCAGCTTCA

ATGATTAAACGCTACGATGAACATCATCAAGACTTGACTCTTTTAAAAGCTTTAGTTCGACAAC

AACTTCCAGAAAAGTATAAAGAAATCTTTTTTGATCAATCAAAAAACGGATATGCAGGTTATAT

TGATGGGGGAGCTAGCCAAGAAGAATTTTATAAATTTATCAAACCAATTTTAGAAAAAATGGAT

GGTACTGAGGAATTATTGGTGAAACTAAATCGTGAAGATTGCTGCGCAAGCAACGGACCTTTG

ACAACGGCTCTATTCCCCATCAAATTCACTTGGGTGAGCTGCATGCTATTTTGAGAAGACAAGA

AGACTTTTATCCATTTTTAAAAGACAATCGTGAGAAGATTGAAAAAATCTTGACTTTTCGAATT

CCTTATTATGTTGGTCCATTGGCGCGTGGCAATAGTCGTTTTGCATGGATGACTCGGAAGTCTG

AAGAAACAATTACCCCATGGAATTTTGAAGAAGTTGTCGATAAAGGTGCTTCAGCTCAATCATT

TATTGAACGCATGACAAACTTTGATAAAAATCTTCCAAATGAAAAAGTACTACCAAAACATAGT

TTGCTTTATGAGTATTTTACGGTTTATAACGAATTGACAAAGGTCAAATATGTTACTGAAGGAA

TGCGAAAACCAGCATTTCTTTCAGGTGAACAGAAGAAAGCCATTGTTGATTTACTCTTCAAAAC

AAATCGAAAAGTAACCGTTAAGCAATTAAAAGAAGATTATTTCAAAAAAATAGAATGTTTTGAT

AGTGTTGAAATTTCAGGAGTTGAAGATAGATTTAATGCTTCATTAGGTACCTACCATGATTTGC

TAAAAATTATTAAAGATAAAGATTTTTTGGATAATGAAGAAATGAAGATATCTTAGAGGATAT

TGTTTTAACATTGACCTTATTTGAAGATAGGGAGATGATTGAGGAAAGACTTAAAACATATGCT

CACCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTTTT
```

-continued

```
GAAATCAGATGGTTTTGCCAATCGCAATTTTATGCAGCTGATCCATGATGATAGTTTGACATTT
AAAGAAGACATTCAAAAAGCACAAGTGTCTGGACAAGGCGATAGTTTACATGAACATATTGCAA
ATTTAGCTGGTAGCCCTGCTATTAAAAAAGGTATTTTACAGACTGTAAAAGTTGTTGATGAATT
GGTCAAAGTAATGGGGCGGCATAAGCCAGAAAATATCGTTATTGAAATGGCACGTGAAAATCAG
ACAACTCAAAAGGGCCAGAAAAATTCGCGAGAGCGTATGAAACGAATCGAAGAAGGTATCAAAG
AATTAGGAAGTCAGATTCTTAAAGAGCATCCTGTTGAAAATACTCAATTGCAAAATGAAAAGCT
CTATCTCTATTATCTCCAAAATGGAAGAGACATGTATGTGGACCAAGAATTAGATATTAATCGT
TTAAGTGATTATGATGTCGATCACATTGTTCCACAAAGTTTCCTTAAAGACGATTCAATAGACA
ATAAGGTCTTAACGCGTTCTGATAAAAATCGTGGTAAATCGGATAACGTTCCAAGTGAAGAAGT
AGTCAAAAAGATGAAAAACTATTGGAGACAACTTCTAAACGCCAAGTTAATCACTCAACGTAAG
TTTGATAATTTAACGAAAGCTGAACGTGGAGGTTTGAGTGAACTTGATAAAGCTGGTTTTATCA
AACGCCAATTGGTTGAAACTCGCCAAATCACTAAGCATGTGGCACAAATTTTGGATAGTCGCAT
GAATACTAAATACGATGAAAATGATAAACTTATTCGAGAGGTTAAAGTGATTACCTTAAAATCT
AAATTAGTTTCTGACTTCCGAAAAGATTTCCAATTCTATAAAGTACGTGAGATTAACAATTACC
ATCATGCCCATGATGCGTATCTAAATGCCGTCGTTGGAACTGCTTTGATTAAGAAATATCCAAA
ACTTGAATCGGAGTTTGTCTATGGTGATTATAAAGTTTATGATGTTCGTAAAATGATTGCTAAG
TCTGAGCAAGAAATAGGCAAAGCAACCGCAAAATATTTCTTTTACTCTAATATCATGAACTTCT
TCAAAACAGAAATTACACTGCAAATGGAGAGATTCGCAAACGCCCTCTAATCGAAACTAATGG
GGAAACTGGAGAAATTGTCTGGGATAAAGGGCGAGATTTTGCCACAGTGCGCAAAGTATTGTCC
ATGCCCCAAGTCAATATTGTCAAGAAAACAGAAGTACAGACAGGCGGATTCTCCAAGGAGTCAA
TTTTACCAAAAGAAATTCGGACAAGCTTATTGCTCGTAAAAAAGACTGGGATCCAAAAAAATA
TGGTGGTTTTGATAGTCCAACGGTAGCTTATTCAGTCCTAGTGGTTGCTAAGGTGGAAAAAGGG
AAATCGAAGAAGTTAAAATCCGTTAAAGAGTTACTAGGGATCACAATTATGGAAAGAAGTTCCT
TTGAAAAAAATCCGATTGACTTTTTAGAAGCTAAAGGATATAAGGAAGTTAAAAAAGACTTAAT
CATTAAACTACCTAAATATAGTCTTTTTGAGTTAGAAAACGGTCGTAAACGGATGCTGGCTAGT
GCCGGAGAATTACAAAAAGGAAATGAGCTGGCTCTGCCAAGCAAATATGTGAATTTTTTATATT
TAGCTAGTCATTATGAAAAGTTGAAGGGTAGTCCAGAAGATAACGAACAAAAACAATTGTTTGT
GGAGCAGCATAAGCATTATTTAGATGAGATTATTGAGCAAATCAGTGAATTTTCTAAGCGTGTT
ATTTTAGCAGATGCCAATTTAGATAAAGTTCTTAGTGCATATAACAAACATAGAGACAAACCAA
TACGTGAACAAGCAGAAAATATTATTCATTTATTTACGTTGACGAATCTTGGAGCTCCCGCTGC
TTTTAAATATTTTGATACAACAATTGATCGTAAACGATATACGTCTACAAAAGAAGTTTTAGAT
GCCACTCTTATCCATCAATCCATCACTGGTCTTTATGAAACACGCATTGATTTGAGTCAGCTAG
GAGGTGACTGA
```

(SEQ ID NO: 82)
MDKK<u>YSIGLDIGTNSVGWAVITDEYKVPSKKFKVLGNTDRHSIKKNLIGALLFDSGET</u>AEATRL
KRTARRRYTRRKNRICYLQEIFSNEMAKVDDSFFHRLEESFLVEEDKKHERHPIFGNIVDEVAY
HEKYPTIYHLRKKLVDSTDKADLRLIYLALAHMIKFRGHFLIEGDLNPDNSDVDKLFIQLVQTY
NQLFEENPINASGVDAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDILRVNTEITKAPLSAS
MIKRYDEHHQDLTLLKALVRQQLPEKYKEIFFDQSKNGYAGYIDGGASQEEFYKFIKPILEKMD
GTEELLVKLNREDLLRKQRTFDNGSIPHQIHLGELHAILRRQEDFYPFLKDNREKIEKILTFRI

```
PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD
(single underline: HNH domain; double underline: RuvC domain).
```

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria meningitidis* (NCBI Ref: YP_002342100.1) or to a Cas9 from any other organism.

In some embodiments, the Cas9 domain comprises a D10A mutation, while the residue at position 840 remains a histidine in the amino acid sequence provided above, or at corresponding positions in any of the amino acid sequences provided herein.

In some embodiments, dCas9 corresponds to, or comprises, in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9. In some embodiments, the dCas9 comprises the amino acid sequence of dCas9 (D10A and H840A):

```
                                          (SEQ ID NO: 83)
MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDAIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD
(single underline: HNH domain; double underline:
RuvC domain).
```

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g, substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. Exemplary amino acid sequences of suitable Cas9 domains and Cas9 fragments are provided herein, and additional suitable sequences of Cas9 domains and fragments will be apparent to those of skill in the art.

A Cas9 protein can associate with a guide RNA that guides the Cas9 protein to a specific DNA sequence that has complementary to the guide RNA. In some embodiments, the polynucleotide programmable nucleotide binding domain is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i.

A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., *Science.* 337:816-821(2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., *Cell.* 28; 152(5):1173-83 (2013)).

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments, the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840. In some embodiments, the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10, or a corresponding mutation. In some embodiments, the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth herein, or a corresponding mutation in any of the amino acid sequences provided herein, wherein X is any amino acid change. In some embodiments, the nuclease-inactive dCas9 domain comprises a D0A mutation and a H840A mutation of the amino acid sequence set forth herein, or a corresponding mutation in any of the amino acid sequences provided herein. As one example, a nuclease-inactive Cas9 domain comprises the amino acid sequence set forth in Cloning vector pPlatTET-gRNA2 (Accession No. BAV54124):

(SEQ ID NO: 83)
```
MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESPFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTEDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLEKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL
```

QNGRDMYVDQELDINRLSDYDVDAIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFEKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD (see, e.g., Qi et al., "Repurposing CRISPR as an RNA-guided platform for sequence-specific control of gene expression." Cell. 2013; 152(5): 1173-83, the entire contents of which are incorporated herein by reference).

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

Exemplary catalytically inactive Cas9 (dCas9):

(SEQ ID NO: 83)
MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFEIRL

EESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINA

SGVDAKAILSARLSKSRRLENLIAQLPGEKKNGLFGNLIALSLGLTPNFKS

NFDLAEDAKLQLSKDTYDDDLDNLLAQIGDQYADLFLAAKNLSDAILLSDI

LRVNTEITKAPLSASMIKRYDEHHQDLTLLKALVRQQLPEKYKEIFFDQSK

NGYAGYIDGGASQEEFYKFIKPILEKMDGTEELLVKLNREDLLRKQRTEDN

GSIPHQIHLGELHAILRRQEDFYPFLKDNREKIEKILTFRIPYYVGPLARG

NSRFAWMTRKSEETITPWNFEEVVDKGASAQSFIERMTNFDKNLPNEKVLP

KHSLLYEYFTVYNELTKVKYVTEGMRKPAFLSGEQKKAIVDLLFKTNRKVT

VKQLKEDYFKKIECEDSVEISGVEDRFNASLGTYHDLLKIIKDKDFLDNEE

NEDILEDIVLTLTLFEDREMIEERLKTYAHLFDDKVMKQLKRRRYTGWGRL

SRKLINGIRDKQSGKTILDFLKSDGFANRNFMQLIHDDSLTFKEDIQKAQV

SGQGDSLHEHIANLAGSPAIKKGILQTVKVVDELVKVMGRHKPENIVIEMA

RENQTTQKGQKNSRERMKRIEEGIKELGSQILKEHPVENTQLQNEKLYLYY

LQNGRDMYVDQELDINRLSDYDVDAIVPQSFLKDDSIDNKVLTRSDKNRGK

SDNVPSEEVVKKMKNYWRQLLNAKLITQRKFDNLTKAERGGLSELDKAGFI

KRQLVETRQITKHVAQILDSRMNTKYDENDKLIREVKVITLKSKLVSDFRK

DFQFYKVREINNYHHAHDAYLNAVVGTALIKKYPKLESEFVYGDYKVYDVR

KMIAKSEQEIGKATAKYFFYSNIMNFEKTEITLANGEIRKRPLIETNGETG

EIVWDKGRDFATVRKVLSMPQVNIVKKTEVQTGGFSKESILPKRNSDKLIA

RKKDWDPKKYGGFDSPTVAYSVLVVAKVEKGKSKKLKSVKELLGITIMERS

SFEKNPIDFLEAKGYKEVKKDLIIKLPKYSLFELENGRKRMLASAGELQKG

NELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFK

YFDTTIDRKRYTSTKEVLDATLIHQSITGLYETRIDLSQLGGD

An example of a Cas9 nickase (nCas9) is set forth below:

(SEQ ID NO: 84)
MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFEIRL

EESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINA

SGVDAKAILSARLSKSRRLENLIAQLPGEKKNGLFGNLIALSLGLTPNFKS

NFDLAEDAKLQLSKDTYDDDLDNLLAQIGDQYADLFLAAKNLSDAILLSDI

LRVNTEITKAPLSASMIKRYDEHHQDLTLLKALVRQQLPEKYKEIFFDQSK

NGYAGYIDGGASQEEFYKFIKPILEKMDGTEELLVKLNREDLLRKQRTEDN

GSIPHQIHLGELHAILRRQEDFYPFLKDNREKIEKILTFRIPYYVGPLARG

NSRFAWMTRKSEETITPWNFEEVVDKGASAQSFIERMTNFDKNLPNEKVLP

KHSLLYEYFTVYNELTKVKYVTEGMRKPAFLSGEQKKAIVDLLEKTNRKVT

VKQLKEDYFKKIECEDSVETSGVEDRFNASLGTYHDLLKIIKDKDFLDNEE

NEDILEDIVLTLTLFEDREMIEERLKTYAHLFDDKVMKQLKRRRYTGWGRL

SRKLINGIRDKQSGKTILDFLKSDGFANRNFMQLIHDDSLTFKEDIQKAQV

SGQGDSLHEHIANLAGSPAIKKGILQTVKVVDELVKVMGRHKPENIVIEMA

RENQTTQKGQKNSRERMKRIEEGIKELGSQILKEHPVENTQLQNEKLYLYY

LQNGRDMYVDQELDINRLSDYDVDHIVPQSFLKDDSIDNKVLTRSDKNRGK

SDNVPSEEVVKKMKNYWRQLLNAKLITQRKFDNLTKAERGGLSELDKAGFI

KRQLVETRQITKHVAQILDSRMNTKYDENDKLIREVKVITLKSKLVSDFRK

DFQFYKVREINNYHHAHDAYLNAVVGTALIKKYPKLESEFVYGDYKVYDVR

KMIAKSEQEIGKATAKYFFYSNIMNFEKTEITLANGEIRKRPLIETNGETG

EIVWDKGRDFATVRKVLSMPQVNIVKKTEVQTGGFSKESILPKRNSDKLIA

RKKDWDPKKYGGFDSPTVAYSVLVVAKVEKGKSKKLKSVKELLGITIMERS

SFEKNPIDFLEAKGYKEVKKDLIIKLPKYSLFELENGRKRMLASAGELQKG

NELALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAAFK

YFDTTIDRKRYTSTKEVLDATLIHQSITGLYETRIDLSQLGGD.

An example of a catalytically active Cas9 is set forth below:

(SEQ ID NO: 267)
MDKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFEIRL

EESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINA

SGVDAKAILSARLSKSRRLENLIAQLPGEKKNGLFGNLIALSLGLTPNEKS

NEDLAEDAKLQLSKDTYDDDLDNLLAQIGDQYADLFLAAKNLSDAILLSDI

LRVNTEITKAPLSASMIKRYDEHHQDLTLLKALVRQQLPEKYKEIFFDQSK

NGYAGYIDGGASQEEFYKFIKPILEKMDGTEELLVKLNREDLLRKQRTEDN

GSIPHQIHLGELHAILRRQEDFYPFLKDNREKIEKILTFRIPYYVGPLARG

NSRFAWMTRKSEETITPWNFEEVVDKGASAQSFIERMTNFDKNLPNEKVLP

KHSLLYEYFTVYNELTKVKYVTEGMRKPAFLSGEQKKAIVDLLEKTNRKVT

VKQLKEDYFKKIECEDSVETSGVEDRFNASLGTYHDLLKIIKDKDFLDNEE

NEDILEDIVLTLTLFEDREMIEERLKTYAHLFDDKVMKQLKRRRYTGWGRL

SRKLINGIRDKQSGKTILDFLKSDGFANRNFMQLIHDDSLTFKEDIQKAQV

SGQGDSLHEHIANLAGSPAIKKGILQTVKVVDELVKVMGRHKPENIVIEMA

RENQTTQKGQKNSRERMKRIEEGIKELGSQILKEHPVENTQLQNEKLYLYY

LQNGRDMYVDQELDINRLSDYDVDHIVPQSFLKDDSIDNKVLTRSDKNRGK

SDNVPSEEVVKKMKNYWRQLLNAKLITQRKFDNLTKAERGGLSELDKAGFI

KRQLVETRQITKHVAQILDSRMNTKYDENDKLIREVKVITLKSKLVSDFRK

DFQFYKVREINNYHHAHDAYLNAVVGTALIKKYPKLESEFVYGDYKVYDVR

KMIAKSEQEIGKATAKYFFYSNIMNFEKTEITLANGEIRKRPLIETNGETG

EIVWDKGRDFATVRKVLSMPQVNIVKKTEVQTGGFSKESILPKRNSDKLIA

RKKDWDPKKYGGFDSPTVAYSVLVVAKVEKGKSKKLKSVKELLGITIMERS

SFEKNPIDFLEAKGYKEVKKDLIIKLPKYSLFELENGRKRMLASAGELQKG

NELALPSKYVNFLYLASHYEKLKGSPEDNEQKQLFVEQHKHYLDEIIEQIS

-continued

EFSKRVILADANLDKVLSAYNKHRDKPIREQAENIIHLFTLTNLGAPAAFK

YFDTTIDRKRYTSTKEVLDATLIHQSITGLYETRIDLSQLGGD.

In some embodiments, Cas9 refers to a Cas9 from archaea (e.g. nanoarchaea), which constitute a domain and kingdom of single-celled prokaryotic microbes. In some embodiments, a nucleic acid programmable DNA binding protein refers to CasX or CasY, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. Ibis divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, in a base editor system described herein Cas9 is replaced by CasX, or a variant of CasX. In some embodiments, in a base editor system described herein Cas9 is replaced by CasY, or a variant of CasY. It should be appreciated that other RNA-guided DNA binding proteins may be used as a nucleic acid programmable DNA binding protein (napDNAbp), and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that CasX and CasY from other bacterial species may also be used in accordance with the present disclosure.

The following Cas sequences are provided by way of example:

```
CasX(uniprot.org/uniprot/F0NN87; uniprot.org/uniprot/F0NH53)
tr|F0NN87|F0NN87_SULIH CRISPR-associated Casx protein
OS = Sulfolobus islandicus (strain HVE10/4) GN = SiH_0402
PE = 4 SV = 1:
```

(SEQ ID NO: 85)
MEVPLYNIFGDNYIIQVATEAENSTIYNNKVEIDDEELRNVLNLAYKIAKNNEDAAAER

RGKAKKKKGEEGETTTSNIILPLSGNDKNPWTETLKCYNFPTTVALSEVFKNFSQVKEC

EEVSAPSFVKPEFYEFGRSPGMVERTRRVKLEVEPHYLIIAAAGWVLTRLGKAKVSEGD

YVGVNVFTPTRGILYSLIQNVNGIVPGIKPETAFGLWIARKVVSSVTNPNVSVVRIYTISD

AVGQNPTTINGGFSIDLTKLLEKRYLLSERLEAIARNALSISSNMRERYIVLANYIYEYLT

G SKRLEDLLYFANRDLIMNLNSDDGKVRDLKLISAYVNGELIRGEG.

-continued

\>tr|F0NH53|F0NH53_SULIR CRISPR associated protein, Casx
OS = *Sulfolobus islandicus* (strain REY15A) GN = SiRe_0771
PE = 4 SV = 1:

(SEQ ID NO: 86)
MEVPLYNIFGDNYIIQVATEAENSTIYNNKVEIDDEELRNVLNLAYKIAKNNEDAAAER

RGKAKKKKGEEGETTTSNIILPLSGNDKNPWTETLKCYNFPTTVALSEVFKNFSQVKEC

EEVSAPSFVKPEFYKFGRSPGMVERTRRVKLEVEPHYLIMAAAGWVLTRLGKAKVSEG

DYVGVNVFTPTRGILYSLIQNVNGIVPGIKPETAFGLWIARKVVSSVTNPNVSVVSIYTIS

DAVGQNPTTINGGFSIDLTKLLEKRDLLSERLEAIARNALSISSNMRERYIVLANYIYEYL

TGSKRLEDLLYFANRDLIMNLNSDDGKVRDLKLISAYVNGELIRGEG.

Deltaproteobacteria CasX
(SEQ ID NO: 87)
MEKRINKIRKKLSADNATKPVSRSGPMKTLLVRVMTDDLKKRLEKRRKKPEVMPQVIS

NNAANNLRMLLDDYTKMKEAILQVYWQEFKDDHVGLMCKFAQPASKKIDQNKLKPE

MDEKGNLTTAGFACSQCGQPLFVYKLEQVSEKGKAYTNYFGRCNVAEHEKLILLAQLK

PVKDSDEAVTYSLGKFGQRALDFYSIHVTKESTHPVKPLAQIAGNRYASGPVGKALSDA

CMGTIASFLSKYQDIIIEHQKVVKGNQKRLESLRELAGKENLEYPSVTLPPQPHTKEGVD fAYNEVIARVRMWVNLNLWQKLKLSRDDAKPLLRLKGFPSFPVVERRENEVDWWNTI

NEVKKLIDAKRDMGRVFWSGVTAEKRNTILEGYNYLPNENDHKKREGSLENPKKPAK

RQFGDLLLYLEKKYAGDWGKVFDEAWERIDKKIAGLTSHIEREEARNAEDAQSKAVLT

DWLRAKASFVLERLKEMDEKEFYACEIQLQKWYGDLRGNPFAVEAENRVVDISGFSIG

SDGHSIQYRNLLAWKYLENGKREFYLLMNYGKKGRIRFTDGTDIKKSGKWQGLLYGG

GKAKVIDLTFDPDDEQLIILPLAFGTRQGREFIWNDLLSLETGLIKLANGRVIEKTIYNKK

IGRDEPALFVALTFERREVVDPSNIKPVNLIGVARGENIPAVIALTDPEGCPLPEFKDSSG

GPTDILRIGEGYKEKQRAIQAAKEVEQRRAGGYSRKFASKSRNLADDMVRNSARDLFY

HAVTHDAVLVFANLSRGFGRQGKRTFMTERQYTKMEDWLTAKLAYEGLTSKTYLSKT

LAQYTSKTCSNCGFTITYADMDVMLVRLKKTSDGWATTLNNKELKAEYQITYYNRYK

RQTVEKELSAELDRLSEESGNNDISKWTKGRRDEALFLLKKRFSHRPVQEQFVCLDCGH

EVHAAEQAALNIARSWLFLNSNSTEFKSYKSGKQPFVGAWQAFYKRRLKEVWKPNA.

CasY (ncbi.nlm.nih.gov/protein/APG80656.1) >APG80656.1
CRISPR-associated protein CasY [uncultured Parcubacteria
group bacterium]:

(SEQ ID NO: 88)
MSKRHPRISGVKGYRLHAQRLEYTGKSGAMRTIKYPLYSSPSGGRTVPREIVSAINDDY

VGLYGLSNFDDLYNAEKRNEEKVYSVLDFWYDCVQYGAVFSYTAPGLLKNVAEVRG

GSYELTKTLKGSHLYDELQIDKVIKFLNKKEISRANGSLDKLKKDIIDCFKAEYRERHKD

QCNKLADDIKNAKKDAGASLGERQKKLFRDFFGISEQSENDKPSFTNPLNLTCCLLPFD

TVNNNRNRGEVLFNKLKEYAQKLDKNEGSLEMWEYIGIGNSGTAFSNFLGEGFLGRLR

ENKITELKKAMMDITDAWRGQEQEEELEKRLRILAALTIKLREPKFDNHWGGYRSDING

KLSSWLQNYINQTVKIKEDLKGHKKDLKKAKEMINRFGESDTKEEAVVSSLLESIEKIVP

DDSADDEKPDIPAIAIYRRFLSDGRLTLNRFVQREDVQEALIKERLEAEKKKKPKKRKK

KSDAEDEKETIDFKELFPHLAKPLKLVPNFYGDSKRELYKKYKNAAIYTDALWKAVEKI

YKSAFSSSLKNSFFDTDFDKDFFIKRLQKIFSVYRRFNTDKWKPIVKNSFAPYCDIVSLAE

NEVLYKPKQSRSRKSAAIDKNRVRLPSTENIAKAGIALARELSVAGFDWKDLLKKEEHE

EYIDLIELHKTALALLLAVTETQLDISALDFVENGTVKDFMKTRDGNLVLEGRFLEMFS

QSIVFSELRGLAGLMSRKEFITRSAIQTMNGKQAELLYIPHEFQSAKITTPKEMSRAFLDL

-continued

```
APAEFATSLEPESLSEKSLLKLKQMRYYPHYFGYELTRTGQGIDGGVAENALRLEKSPV

KKREIKCKQYKTLGRGQNKIVLYVRSSYYQTQFLEWFLHRPKNVQTDVAVSGSFLIDE

KKVKTRWNYDALTVALEPVSGSERVFVSQPFTIFPEKSAEEEGQRYLGIDIGEYGIAYTA

LEITGDSAKILDQNFISDPQLKTLREEVKGLKLDQRRGTFAMPSTKIARIRESLVHSLRNR

IHHLALKHKAKIVYELEVSRFEEGKQKIKKVYATLKKADVYSEIDADKNLQTTVWGKL

AVASEISASYTSQFCGACKKLWRAEMQVDETITTQELIGTVRVIKGGTLIDAIKDFMRPP

IFDENDTPFPKYRDFCDKHHISKKMRGNSCLFICPFCRANADADIQASQTIALLRYVKEE

KKVEDYFERFRKLKNIKVLGQMKKI

Cas12b/C2c1 (uniprot.org/uniprot/T0D7A2#2) sp|T0D7A2|C2C1_ALIAG
CRISPR-associated endo-nuclease C2c1 OS = Alicyclobacillus
acido-terrestris (strain ATCC 49025/DSM 3922/CIP 106132/
NCIMB 13137/GD3B) GN = c2c1 PE = 1 SV = 1:
                                          (SEQ ID NO: 89)
MAVKSIKVKLRLDDMPEIRAGLWKLHKEVNAGVRYYTEWLSLLRQENLYRRSPNGDG

EQECDKTAEECKAELLERLRARQVENGHRGPAGSDDELLQLARQLYELLVPQAIGAKG

DAQQIARKFLSPLADKDAVGGLGIAKAGNKPRWVRMREAGEPGWEEEKEKAETRKSA

DRTADVLRALADFGLKPLMRVYTDSEMSSVEWKPLRKGQAVRTWDRDMFQQAIERM

MSWESWNQRVGQEYAKLVEQKNRFEQKNFVGQEHLVHLVNQLQQDMKEASPGLESK

EQTAHYVTGRALRGSDKVFEKWGKLAPDAPFDLYDAEIKNVQRRNTRRFGSHDLFAK

LAEPEYQALWREDASFLTRYAVYNSILRKLNHAKMFATFTLPDATAHPIWTRFDKLGG

NLHQYTFLFNEFGERRHAIRFHKLLKVENGVAREVDDVTVPISMSEQLDNLLPRDPNEPI

ALYFRDYGAEQHFTGEFGGAKIQCRRDQLAHMHRRRGARDVYLNVSVRVQSQSEARG

ERRPPYAAVFRLVGDNHRAFVHFDKLSDYLAEHPDDGKLGSEGLLSGLRVMSVDLGLR

TSASISVFRVARKDELKPNSKGRVPFFFPIKGNDNLVAVHERSQLLKLPGETESKDLRAI

REERQRTLRQLRTQLAYLRLLVRCGSEDVGRRERSWAKLIEQPVDAANHMTPDWREA

FENELQKLKSLHGICSDKEWMDAVYESVRRVWRHMGKQVRDWRKDVRSGERPKIRG

YAKDVVGGNSIEQIEYLERQYKFLKSWSFFGKVSGQVIRAEKGSRFAITLREHIDHAKED

RLKKLADRIIMEALGYVYALDERGKGKWVAKYPPCQLILLEELSEYQFNNDRPPSENN

QLMQWSHRGVFQELINQAQVHDLLVGTMYAAFSSRFDARTGAPGIRCRRVPARCTQE

HNPEPFPWWLNKFVVEHTLDACPLRADDLIPTGEGEIFVSPFSAEEGDFHQIHADLNAA

QNLQQRLWSDFDISQIRLRCDWGEVDGELVLIPRLTGKRTADSYSNKVFYTNTGVTYY

ERERGKKRRKVFAQEKLSEEEAELLVEADEAREKSVVLMRDPSGIINRGNWTRQKEFW

SMVNQRIEGYLVKQIRSRVPLQDSACENTGDI.
```

In some embodiments, one of the Cas9 domains present in the fusion protein may be replaced with a guide nucleotide sequence-programmable DNA-binding protein domain that has no requirements for a PAM sequence.

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, Cas12b/C2c1, and Cas12c/C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (Cas12b/C2c1, and Cas12c/C2c3) have been described by Shmakov et al., "Discovery and Functional Characterization of Diverse Class 2 CRISPR Cas Systems", Mol. Cell. 2015 Nov. 5; 60(3): 385-397, the entire contents of which is hereby incorporated by reference. Effectors of two of the systems, Cas12b/C2c1, and Cas12c/C2c3, contain RuvC-like endonuclease domains related to Cpf1. A third system, contains an effector with two predicated HEPN RNase domains. Production of mature CRISPR RNA is tracrRNA-independent, unlike production of CRISPR RNA by Cas12b/C2c1. Cas12b/C2c1 depends on both CRISPR RNA and tracrRNA for DNA cleavage.

The crystal structure of Alicyclobacillus acidoterrestris Cas12b/C2c1 (AacC2c1) has been reported in complex with a chimeric single-molecule guide RNA (sgRNA). See e.g., Liu et al., "C2c1-sgRNA Complex Structure Reveals RNA- Guided DNA Cleavage Mechanism", *Mol. Cell.* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell.* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with Cas12b/C2c1-mediated cleavage resulting in a staggered seven-nucleotide break of target DNA. Structural comparisons between Cas12b/C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a Cas12b/C2c1, or a Cas12c/C2c3 protein. In some embodiments, the napDNAbp is a Cas12b/C2c1 protein. In some embodiments, the napDNAbp is a Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring Cas12b/C2c1 or Cas12c/C2c3 protein. In some embodiments, the napDNAbp is a naturally-occurring Cas12b/C2c1 or Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of the napDNAbp sequences provided herein. It should be appreciated that Cas12b/C2c1 or Cas12c/C2c3 from other bacterial species may also be used in accordance with the present disclosure.

A Cas12b/C2c1 (uniprot.org/uniprot/T0D7A2 #2) sp|TOD7A2|/C2C1_ALIAG CRISPR-associated endonuclease C2c1 OS=*Alicyclobacillus* acido-*terrestris* (strain ATCC 49025/DSM 3922/CIP 106132/NCIMB 13137/GD3B) GN=c2c1 PE=1 SV=1 amino acid sequence is provided as follows:

```
(SEQ ID NO: 89)
MAVKSIKVKLRLDDMPEIRAGLWKLHKEVNAGVRYYTEWLSLLRQENLYRR

SPNGDGEQECDKTAEECKAELLERLRARQVENGHRGPAGSDDELLQLARQL

YELLVPQAIGAKGDAQQIARKFLSPLADKDAVGGLGIAKAGNKPRWVRMRE

AGEPGWEEEKEKAETRKSADRTADVLRALADFGLKPLMRVYTDSEMSSVEW

KPLRKGQAVRTWDRDMFQQAIERMMSWESWNQRVGQEYAKLVEQKNRFEQK

NFVGQEHLVHLVNQLQQDMKEASPGLESKEQTAHYVTGRALRGSDKVFEKW

GKLAPDAPFDLYDAEIKNVQRRNTRRFGSHDLFAKLAEPEYQALWREDASF

LTRYAVYNSILRKLNHAKMFATFTLPDATAHPIWTRFDKLGGNLHQYTELF

NEFGERRHAIRFHKLLKVENGVAREVDDVTVPISMSEQLDNLLPRDPNEPI

ALYFRDYGAEQHFTGEFGGAKIQCRRDQLAHMHRRRGARDVYLNVSVRVQS

QSEARGERRPPYAAVERLVGDNHRAFVHFDKLSDYLAEHPDDGKLGSEGLL

SGLRVMSVDLGLRTSASISVFRVARKDELKPNSKGRVPFFFPIKGNDNLVA

VHERSQLLKLPGETESKDLRAIREERQRTLRQLRTQLAYLRLLVRCGSEDV

GRRERSWAKLIEQPVDAANHMTPDWREAFENELQKLKSLHGICSDKEWMDA

VYESVRRVWRHMGKQVRDWRKDVRSGERPKIRGYAKDVVGGNSIEQIEYLE

RQYKFLKSWSFFGKVSGQVIRAEKGSRFAITLREHIDHAKEDRLKKLADRI

EVIEALGYVYALDERGKGKWVAKYPPCQLILLEELSEYQFNNDRPPSENNQ

LMQWSHRGVFQELINQAQVHDLLVGTMYAAFSSRFDARTGAPGIRCRRVPA

RCTQEHNPEPFPWWLNKFVVEHTLDACPLRADDLIPTGEGEIFVSPFSAEE

GDFHQIHADLNAAQNLQQRLWSDFDISQIRLRCDWGEVDGELVLIPRLTGK

RTADSYSNKVFYTNTGVTYYERERGKKRRKVFAQEKLSEEEAELLVEADEA

REKSVVLMRDPSGIINRGNWTRQKEFWSMVNQRIEGYLVKQIRSRVPLQDS

ACENTGDI
```

A BhCas12b (*Bacillus* hisashii), NCBI Reference Sequence: WP_095142515, amino acid sequence is provided as follows:

```
(SEQ ID NO: 90)
MAPKKKRKVGIHGVPAAATRSFILKIEPNEEVKKGLWKTHEVLNHGIAYYM

NILKLIRQEAIYEHHEQDPKNPKKVSKAEIQAELWDFVLKMQKCNSFTHEV

DKDEVFNILRELYEELVPSSVEKKGEANQLSNKFLYPLVDPNSQSGKGTAS

SGRKPRWYNLKIAGDPSWEEEKKKWEEDKKKDPLAKILGKLAEYGLIPLFI

PYTDSNEPIVKEIKWMEKSRNQSVRRLDKDMFIQALERFLSWESWNLKVKE

EYEKVEKEYKTLEERIKEDIQALKALEQYEKERQEQLLRDTLNTNEYRLSK

RGLRGWREIIQKWLKMDENEPSEKYLEVFKDYQRKHPREAGDYSVYEFLSK

KENHFIWRNHPEYPYLYATFCEIDKKKKDAKQQATFTLADPINHPLWVRFE

ERSGSNLNKYRILTEQLHTEKLKKKLTVQLDRLIYPTESGGWEEKGKVDIV

LLPSRQFYNQIFLDIEEKGKHAFTYKDESIKFPLKGTLGGARVQFDRDHLR

RYPHKVESGNVGRIYFNMTVNIEPTESPVSKSLKIHRDDFPKVVNFKPKEL

TEWIKDSKGKKLKSGIESLEIGLRVMSIDLGQRQAAAASIFEVVDQKPDIE

GKLFFPIKGTELYAVHRASFNIKLPGETLVKSREVLRKAREDNLKLMNQKL

NFLRNVLHFQQFEDITEREKRVTKWISRQENSDVPLVYQDELIQIRELMYK

PYKDWVAFLKQLHKRLEVEIGKEVKHWRKSLSDGRKGLYGISLKNIDEIDR

TRKFLLRWSLRPTEPGEVRRLEPGQRFAIDQLNHLNALKEDRLKKMANTII

MHALGYCYDVRKKKWQAKNPACQIILFEDLSNYNPYEERSRFENSKLMKWS

RREIPRQVALQGEIYGLQVGEVGAQFSSRFHAKTGSPGIRCSVVTKEKLQD

NRFFKNLQREGRLTLDKIAVLKEGDLYPDKGGEKFISLSKDRKCVTTHADI

NAAQNLQKRFWTRTHGFYKVYCKAYQVDGQTVYIPESKDQKQKIIEEFGEG

YFILKDGVYEWVNAGKLKIKKGSSKQSSSELVDSDILKDSFDLASELKGEK

LMLYRDPSGNVFPSDKWMAAGVFFGKLERILISKLTNQYSISTIEDDSSKQ

SMKRPAATKKAGQAKKKK.
```

In some embodiments, the Cas12b is BvCas12B, which is a variant of BhCas12b and comprises the following changes relative to BhCas12B: S893R, K846R, and E837G.

A BvCas12b (*Bacillus* sp. V3-13), NCBI Reference Sequence: WP_101661451.1, amino acid sequence is provided:

(SEQ ID NO: 91)
MAIRSIKLKMKTNSGTDSIYLRKALWRTHQLINEGIAYYMNLLTLYRQEAI

GDKTKEAYQAELINIIRNQQRNNGSSEEHGSDQEILALLRQLYELIIPSSI

GESGDANQLGNKFLYPLVDPNSQSGKGTSNAGRKPRWKRLKEEGNPDWELE

KKKDEERKAKDPTVKIFDNLNKYGLLPLFPLFTNIQKDIEWLPLGKRQSVR

KWDKDMFIQAIERLLSWESWNRRVADEYKQLKEKTESYYKEHLTGGEEWIE

KIRKFEKERNMELEKNAFAPNDGYFITSRQIRGWDRVYEKWSKLPESASPE

ELWKVVAEQQNKMSEGFGDPKVFSFLANRENRDIWRGHSERIYHIAAYNGL

QKKLSRTKEQATFTLPDAIEHPLWIRYESPGGTNLNLFKLEEKQKKNYYVT

LSKIIWPSEEKWIEKENIEIPLAPSIQFNRQIKLKQHVKGKQEISFSDYSS

RISLDGVLGGSRIQFNRKYIKNHKELLGEGDIGPVFFNLVVDVAPLQETRN

GRLQSPIGKALKVISSDFSKVIDYKPKELMDWMNTGSASNSFGVASLLEGM

RVMSIDMGQRTSASVSIFEVVKELPKDQEQKLFYSINDTELFAIHKRSFLL

NLPGEVVTKNNKQQRQERRKKRQFVRSQIRMLANVLRLETKKTPDERKKAI

HKLMEIVQSYDSWTASQKEVWEKELNLLTNMAAFNDEIWKESLVELHHRIE

PYVGQIVSKWRKGLSEGRKNLAGISMWNIDELEDTRRLLISWSKRSRTPGE

ANRIETDEPFGSSLLQHIQNVKDDRLKQMANLIEVITALGFKYDKEEKDRY

KRWKETYPACQIILFENLNRYLFNLDRSRRENSRLMKWAHRSIPRTVSMQG

EMFGLQVGDVRSEYSSRFHAKTGAPGIRCHALTEEDLKAGSNTLKRLIEDG

FINESELAYLKKGDIIPSQGGELFVTLSKRYKKDSDNNELTVIHADINAAQ

NLQKRFWQQNSEVYRVPCQLARMGEDKLYIPKSQTETIKKYFGKGSFVKNN

TEQEVYKWEKSEKMKIKTDTTFDLQDLDGFEDISKTIELAQEQQKKYLTMF

RDPSGYFFNNETWRPQKEYWSIVNNIIKSCLKKKILSNKVEL

It should be appreciated that polynucleotide programmable nucleotide binding domains can also include nucleic acid programmable proteins that bind RNA. For example, the polynucleotide programmable nucleotide binding domain can be associated with a nucleic acid that guides the polynucleotide programmable nucleotide binding domain to an RNA. Other nucleic acid programmable DNA binding proteins are also within the scope of this disclosure, though they are not specifically listed in this disclosure.

Cas proteins that can be used herein include class 1 and class 2. Non-limiting examples of Cas proteins include Cas1, Cas1B, Cas2, Cas3, Cas4, Cas5, Cas5d, Cas5t, Cas5h, Cas5a, Cas6, Cas7, Cas8, Cas9 (also known as Csn1 or Csx12), Cas10, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Csd1, Csd2, Cst1, Cst2, Csh1, Csh2, Csa1, Csa2, Csa3, Csa4, Csa5, Cas12a/Cpf1, Cas12b/C2c1, Cas12c/C2c3, Cas12d/CasY, Cas12e/CasX, Cas12g, Cas12h, and Cas12i, CARF, DinG, homologues thereof, or modified versions thereof. An unmodified CRISPR enzyme can have DNA cleavage activity, such as Cas9, which has two functional endonuclease domains: RuvC and HNH. A CRISPR enzyme can direct cleavage of one or both strands at a target sequence, such as within a target sequence and/or within a complement of a target sequence. For example, a CRISPR enzyme can direct cleavage of one or both strands within about 1, 2, 3, 4, 5, 6, 7, 8, 9, 10, 15, 20, 25, 50, 100, 200, 500, or more base pairs from the first or last nucleotide of a target sequence.

A vector that encodes a CRISPR enzyme that is mutated to with respect to a corresponding wild-type enzyme such that the mutated CRISPR enzyme lacks the ability to cleave one or both strands of a target polynucleotide containing a target sequence can be used. Cas9 can refer to a polypeptide with at least or at least about 50%, 60%, 70%, 80%, 90%, 91%, 92%, 93%, 94%, 95%, 96%, 97%, 98%, 99%, or 100% sequence identity and/or sequence homology to a wild type exemplary Cas9 polypeptide (e.g., Cas9 from S. pyogenes). Cas9 can refer to a polypeptide with at most or at most about 50%, 60%, 70%, 80%, 90%, 91%, 92%, 93%, 94%, 95%, 96%, 97%, 98%, 99%, or 100% sequence identity and/or sequence homology to a wild type exemplary Cas9 polypeptide (e.g., from S. pyogenes). Cas9 can refer to the wild type or a modified form of the Cas9 protein that can comprise an amino acid change such as a deletion, insertion, substitution, variant, mutation, fusion, chimera, or any combination thereof.

In some embodiments, the methods described herein can utilize an engineered Cas protein. A guide RNA (gRNA) is a short synthetic RNA composed of a scaffold sequence necessary for Cas-binding and a user-defined ~20 nucleotide spacer that defines the genomic target to be modified. Thus, it will be appreciated that changing the genomic target of the Cas protein specificity is partially determined by the specificity of the gRNA targeting sequence for the genomic target compared to the rest of the genome.

The Cas9 nuclease has two functional endonuclease domains: RuvC and HNH. Cas9 undergoes a second conformational change upon target binding that positions the nuclease domains to cleave opposite strands of the target DNA. The end result of Cas9-mediated DNA cleavage is a double-strand break (DSB) within the target DNA (~3-4 nucleotides upstream of the PAM sequence). The resulting DSB is then repaired by one of two general repair pathways: (1) the efficient but error-prone non-homologous end joining (NHEJ) pathway; or (2) the less efficient but high-fidelity homology directed repair (HDR) pathway.

The "efficiency" of non-homologous end joining (NHEJ) and/or homology directed repair (HDR) can be calculated by any convenient method. For example, in some cases, efficiency can be expressed in terms of percentage of successful HDR. For example, a surveyor nuclease assay can be used to generate cleavage products and the ratio of products to substrate can be used to calculate the percentage. For example, a surveyor nuclease enzyme can be used that directly cleaves DNA containing a newly integrated restriction sequence as the result of successful HDR More cleaved substrate indicates a greater percent HDR (a greater efficiency of HDR). As an illustrative example, a fraction (percentage) of HDR can be calculated using the following equation [(cleavage products)/(substrate plus cleavage products)] (e.g., (b+c)/(a+b+c), where "a" is the band intensity of DNA substrate, and "b" and "c" are the cleavage products).

In some cases, efficiency can be expressed in terms of percentage of successful NHEJ. For example, a T7 endonuclease I assay can be used to generate cleavage products and the ratio of products to substrate can be used to calculate the percentage NHEJ. T7 endonuclease I cleaves mismatched heteroduplex DNA which arises from hybridization of wild-type and mutant DNA strands (NHEJ generates small random insertions or deletions (indels) at the site of the original break). More cleavage indicates a greater percent NHEJ (a greater efficiency of NHEJ). As an illustrative example, a fraction (percentage) of NHEJ can be calculated using the following equation: $(1-(1-(b+c)/(a+b+c))^{1/2}) \times 100$, where "a" is the band intensity of DNA substrate and "b" and "c" are the cleavage products (Ran et. al., Cell. 2013 Sep. 12; 154(6):1380-9; and Ran et al., Nat Protoc. 2013 November; 8(11): 2281-2308).

The NHEJ repair pathway is the most active repair mechanism, and it frequently causes small nucleotide insertions or deletions (indels) at the DSB site. The randomness of NHEJ-mediated DSB repair has important practical implications, because a population of cells expressing Cas9 and a gRNA or a guide polynucleotide can result in a diverse array of mutations. In most cases, NHEJ gives rise to small indels in the target DNA that result in amino acid deletions, insertions, or frameshift mutations leading to premature stop codons within the open reading frame (ORF) of the targeted gene. The ideal end result is a loss-of-function mutation within the targeted gene.

While NHEJ-mediated DSB repair often disrupts the open reading frame of the gene, homology directed repair (HDR) can be used to generate specific nucleotide changes ranging from a single nucleotide change to large insertions like the addition of a fluorophore or tag.

In order to utilize HDR for gene editing, a DNA repair template containing the desired sequence can be delivered into the cell type of interest with the gRNA(s) and Cas9 or Cas9 nickase. The repair template can contain the desired edit as well as additional homologous sequence immediately upstream and downstream of the target (termed left & right homology arms). The length of each homology arm can be dependent on the size of the change being introduced, with larger insertions requiring longer homology arms. The repair template can be a single-stranded oligonucleotide, a double-stranded oligonucleotide, or a double-stranded DNA plasmid. The efficiency of HDR is generally low (<10% of modified alleles) even in cells that express Cas9, gRNA and an exogenous repair template. The efficiency of HDR can be enhanced by synchronizing the cells, since HDR takes place during the S and G2 phases of the cell cycle. Chemically or genetically inhibiting genes involved in NHEJ can also increase HDR frequency.

In some embodiments, Cas9 is a modified Cas9. A given gRNA targeting sequence can have additional sites throughout the genome where partial homology exists. These sites are called off-target sites ("off-targets") and need to be considered when designing a gRNA. In addition to optimizing gRNA design, CRISPR specificity can also be increased through modifications to Cas9. Cas9 generates double-strand breaks (DSBs) through the combined activity of the two nuclease domains, RuvC and HNH. Cas9 nickase, a D10A mutant of SpCas9, retains one nuclease domain and generates a DNA nick rather than a DSB. The nickase system can also be combined with HDR-mediated gene editing for specific gene edits.

In some cases, Cas9 is a variant Cas9 protein. A variant Cas9 polypeptide has an amino acid sequence that is different by one amino acid (e.g., has a deletion, insertion, substitution, fusion) when compared to the amino acid sequence of a wild type Cas9 protein. In some instances, the variant Cas9 polypeptide has an amino acid change (e.g., deletion, insertion, or substitution) that reduces the nuclease activity of the Cas9 polypeptide. For example, in some instances, the variant Cas9 polypeptide has less than 50%, less than 40%, less than 30%, less than 20%, less than 10%, less than 5%, or less than 1% of the nuclease activity of the corresponding wild-type Cas9 protein. In some cases, the variant Cas9 protein has no substantial nuclease activity. When a subject Cas9 protein is a variant Cas9 protein that has no substantial nuclease activity, it can be referred to as "dCas9."

In some cases, a variant Cas9 protein has reduced nuclease activity. For example, a variant Cas9 protein exhibits less than about 20%, less than about 15%, less than about 10%, less than about 5%, less than about 1%, or less than about 0.1%, of the endonuclease activity of a wild-type Cas9 protein, e.g., a wild-type Cas9 protein.

In some cases, a variant Cas9 protein can cleave the complementary strand of a guide target sequence but has reduced ability to cleave the non-complementary strand of a double stranded guide target sequence. For example, the variant Cas9 protein can have a mutation (amino acid substitution) that reduces the function of the RuvC domain. As a non-limiting example, in some embodiments, a variant Cas9 protein has a D10A (aspartate to alanine at amino acid position 10) and can therefore cleave the complementary strand of a double stranded guide target sequence but has reduced ability to cleave the non-complementary strand of a double stranded guide target sequence (thus resulting in a single strand break (SSB) instead of a double strand break (DSB) when the variant Cas9 protein cleaves a double stranded target nucleic acid) (see, for example, Jinek et al., Science. 2012 Aug. 17; 337(6096):816-21).

In some cases, a variant Cas9 protein can cleave the non-complementary strand of a double stranded guide target sequence but has reduced ability to cleave the complementary strand of the guide target sequence. For example, the variant Cas9 protein can have a mutation (amino acid substitution) that reduces the function of the HNH domain (RuvC/HNH/RuvC domain motifs). As a non-limiting example, in some embodiments, the variant Cas9 protein has an H840A (histidine to alanine at amino acid position 840) mutation and can therefore cleave the non-complementary strand of the guide target sequence but has reduced ability to cleave the complementary strand of the guide target sequence (thus resulting in a SSB instead of a DSB when the variant Cas9 protein cleaves a double stranded guide target sequence). Such a Cas9 protein has a reduced ability to cleave a guide target sequence (e.g., a single stranded guide target sequence) but retains the ability to bind a guide target sequence (e.g., a single stranded guide target sequence).

In some cases, a variant Cas9 protein has a reduced ability to cleave both the complementary and the non-complementary strands of a double stranded target DNA. As a non-limiting example, in some cases, the variant Cas9 protein harbors both the D10A and the H840A mutations such that the polypeptide has a reduced ability to cleave both the complementary and the non-complementary strands of a double stranded target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors W476A and W1126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors H840A, W476A, and W1126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors H840A, D10A, W476A, and W1126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, the variant Cas9 has restored catalytic His residue at position 840 in the Cas9 HNH domain (A840H).

As another non-limiting example, in some cases, the variant Cas9 protein harbors, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some cases, when a variant Cas9 protein harbors W476A and W1126A mutations or when the variant Cas9 protein harbors P475A, W476A, N477A, D1125A, W1126A, and D1127A mutations, the variant Cas9 protein does not bind efficiently to a PAM sequence. Thus, in some such cases, when such a variant Cas9 protein is used in a method of binding, the method does not require a PAM sequence. In other words, in some cases, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a variant Cas9 protein that has reduced catalytic activity (e.g., when a Cas9 protein has a D10, G12, G17, E762, H840, N854, N863, H982, H983, A984, D986, and/or a A987 mutation, e.g., D10A, G12A, G17A, E762A, H840A, N854A, N863A, H982A, H983A, A984A, and/or D986A), can still bind to target DNA in a site-specific manner (because it is still guided to a target DNA sequence by a guide RNA) as long as it retains the ability to interact with the guide RNA.

Alternatives to *S. pyogenes* Cas9 can include RNA-guided endonucleases from the Cpf1 family that display cleavage activity in mammalian cells. CRISPR from *Prevotella* and *Francisella* 1 (CRISPR/Cpf1) is a DNA-editing technology analogous to the CRISPR/Cas9 system. Cpf1 is an RNA-guided endonuclease of a class II CRISPR/Cas system. This acquired immune mechanism is found in *Prevotella* and *Francisella* bacteria. Thus, Cpf1 represents an example of a nucleic acid programmable DNA-binding protein that has different PAM specificity than Cas9. Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are described, for example, in Yamano et al., "Crystal structure of Cpf1 in complex with guide RNA and target DNA." *Cell*(165) 2016, p. 949-962; the entire contents of which is hereby incorporated by reference.

Cpf1 genes are associated with the CRISPR locus, coding for an endonuclease that use a guide RNA to find and cleave viral DNA. Because Cpf1 is a smaller and simpler endonuclease than Cas9, Cpf1 can overcome some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1 does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as a Class 2, type V CRISPR system. The Cpf1 loci encode Cas1, Cas2 and Cas4 proteins more similar to types I and III than from type II systems. Functional Cpf1 does not need the trans-activating CRISPR RNA (tracrRNA); therefore, only CRISPR (crRNA) is required. This benefits genome editing because Cpf1 is not only smaller than Cas9, but also it has a smaller sgRNA molecule (approximately half as many nucleotides as Cas9). The Cpf1-crRNA complex cleaves target DNA or RNA by identification of a protospacer adjacent motif 5'-YTN-3' in contrast to the G-rich PAM targeted by Cas9. After identification of PAM, Cpf1 introduces a sticky-end-like, DNA double-stranded break of 4 or 5 nucleotides overhang.

Also useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9, but does not have a HNH endonuclease domain, and the N-terminal of Cpf1 does not have the α-helical recognition lobe of Cas9. It was shown in Zetsche et al., *Cell*. 163, 759-771, 2015 (which is incorporated herein by reference) that the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 inactivate Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a Cpf1 sequence disclosed herein. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a Cpf1 sequence disclosed herein, and comprises mutations corresponding to D917A, E1006A, D1255A, D917A/E1006A, D917A/D1255A, E1006A/D1255A, or D917A/E1006A/D1255A.

It should be appreciated that Cpf1 from other bacterial species may also be used in accordance with the present disclosure. Accordingly, the following exemplary Cpf1 sequences from other bacterial species may also be used in accordance with the present disclosure:

```
Wild type Francisella novicida Cpf1 (D917, E1006, and
D1255 are bolded and underlined)
                                              (SEQ ID NO: 92)
MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSIDRGERHLAYYTLVDGKGNIIKQDTFNIIGNDRMKTNYHDKLAAIE

KDRDSARKDWKKINNIKEMKEGYLSQVVHEIAKLVIEYNAIVVFEDLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

Francisella novicida Cpf1 D917A (A917, E1006, and D1255
are bolded and underlined)
                                              (SEQ ID NO: 93)
MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK
```

-continued

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSIARGERHLAYYTLVDGKGNIIKQDTFNIIGNDRMKTNYHDKLAAIE

KDRDSARKDWKKINNIKEMKEGYLSQVVHEIAKLVIEYNAIVVFEDLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

*Francisella novicida* Cpf1 E1006A (D917, A1006, and D1255 are bolded and underlined)

(SEQ ID NO: 94)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSIDRGERHLAYYTLVDGKGNIIKQDTFNIIGNDRMKTNYHDKLAAIE

KDRDSARKDWKKINNIKEMKEGYLSQVVHEIAKLVIEYNAIVVFADLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

-continued

*Francisella novicida* Cpf1 D1255A (D917, E1006, and A1255 are bolded and underlined)

(SEQ ID NO: 95)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSI<u>D</u>RGERHLAYYTLVDGKGNIIKQDTFNIIGNDRMKTNYHDKLAAIE

KDRDSARKDWKKINNIKEMKEGYLSQVVHEIAKLVIEYNAIVVF<u>E</u>DLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

<u>A</u>ANGAYHIGLKGLMLLGRIKNNQEGKKLNLVIKNEEYFEFVQNRNN

*Francisella novicida* Cpf1 D917A/E1006A (A917, A1006, and D1255 are bolded and underlined)

(SEQ ID NO: 96)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSI<u>A</u>RGERHLAYYTLVDGKGNIIKQDTFNIIGNDRMKTNYHDKLAAIE

-continued

KDRDSARKDWKKINNIKEMKEGYLSQVVHEIAKLVIEYNAIVVFADLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

*Francisella novicida* Cpf1 D917A/D1255A (A917, E1006, and A1255 are bolded and nderlined)

(SEQ ID NO: 97)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSIARGERHLAYYTLVDGKGNIIKQDTFNIIGNDRMKTNYHDKLAAIE

KDRDSARKDWKKINNIKEMKEGYLSQVVHEIAKLVIEYNAIVVFEDLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN

*Francisella novicida* Cpf1 E1006A/D1255A (D917, A1006, and A1255 are bolded and underlined)
(SEQ ID NO: 98)
MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

-continued

```
HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSIDRGERHLAYYTLVDGKGNIIKQDTFNIIGNDRMKTNYHDKLAAIE

KDRDSARKDWKKINNIKEMKEGYLSQVVHEIAKLVIEYNAIVVFADLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN
```

*Francisella novicida* Cpf1 D917A/E1006A/D1255A (A917, A1006, and A1255 are bolded and underlined)

(SEQ ID NO: 99)

```
MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSIARGERHLAYYTLVDGKGNIIKQDTFNIIGNDRMKTNYHDKLAAIE

KDRDSARKDWKKINNIKEMKEGYLSQVVHEIAKLVIEYNAIVVFADLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN
```

A polynucleotide programmable nucleotide binding domain of a base editor can itself comprise one or more domains. For example, a polynucleotide programmable nucleotide binding domain can comprise one or more nuclease domains. In some embodiments, the nuclease domain of a polynucleotide programmable nucleotide binding domain can comprise an endonuclease or an exonuclease. Herein the term "exonuclease" refers to a protein or polypeptide capable of digesting a nucleic acid (e.g., RNA or DNA) from free ends, and the term "endonuclease" refers to a protein or polypeptide capable of catalyzing (e.g. cleaving) internal regions in a nucleic acid (e.g., DNA or RNA). In some embodiments, an endonuclease can cleave a single strand of a double-stranded nucleic acid. In some embodiments, an endonuclease can cleave both strands of a double-stranded nucleic acid molecule. In some embodiments a polynucleotide programmable nucleotide binding domain can be a deoxyribonuclease. In some embodiments a polynucleotide programmable nucleotide binding domain can be a ribonuclease.

In some embodiments, a nuclease domain of a polynucleotide programmable nucleotide binding domain can cut zero, one, or two strands of a target polynucleotide. In some cases, the polynucleotide programmable nucleotide binding domain can comprise a nickase domain. Herein the term "nickase" refers to a polynucleotide programmable nucleotide binding domain comprising a nuclease domain that is capable of cleaving only one strand of the two strands in a duplexed nucleic acid molecule (e.g. DNA). In some embodiments, a nickase can be derived from a fully catalytically active (e.g. natural) form of a polynucleotide programmable nucleotide binding domain by introducing one or more mutations into the active polynucleotide programmable nucleotide binding domain. For example, where a polynucleotide programmable nucleotide binding domain comprises a nickase domain derived from Cas9, the Cas9-derived nickase domain can include a D0A mutation and a histidine (H) at position 840. In such cases, the residue H840 retains catalytic activity and can thereby cleave a single strand of the nucleic acid duplex. In another example, a Cas9-derived nickase domain can comprise an H840A mutation, while the amino acid residue at position 10 remains a D. In some embodiments, a nickase can be derived from a fully catalytically active (e.g. natural) form of a polynucleotide programmable nucleotide binding domain by removing all or a portion of a nuclease domain that is not required for the nickase activity. For example, where a polynucleotide programmable nucleotide binding domain comprises a nickase domain derived from Cas9, the Cas9-derived nickase domain can comprise a deletion of all or a portion of the RuvC domain or the HNH domain.

A base editor comprising a polynucleotide programmable nucleotide binding domain comprising a nickase domain is thus able to generate a single-strand DNA break (nick) at a specific polynucleotide target sequence (e.g. determined by the complementary sequence of a bound guide nucleic acid). In some embodiments, the strand of a nucleic acid duplex target polynucleotide sequence that is cleaved by a base editor comprising a nickase domain (e.g. Cas9-derived nickase domain) is the strand that is not edited by the base editor (i.e., the strand that is cleaved by the base editor is opposite to a strand comprising a base to be edited). In other embodiments, a base editor comprising a nickase domain (e.g. Cas9-derived nickase domain) can cleave the strand of a DNA molecule which is being targeted for editing. In such cases, the non-targeted strand is not cleaved.

Also provided herein are base editors comprising a polynucleotide programmable nucleotide binding domain which is catalytically dead (i.e., incapable of cleaving a target polynucleotide sequence). Herein the terms "catalytically dead" and "nuclease dead" are used interchangeably to refer to a polynucleotide programmable nucleotide binding domain which has one or more mutations and/or deletions resulting in its inability to cleave a strand of a nucleic acid. In some embodiments, a catalytically dead polynucleotide programmable nucleotide binding domain base editor can lack nuclease activity as a result of specific point mutations in one or more nuclease domains. For example, in the case of a base editor comprising a Cas9 domain, the Cas9 can comprise both a D10A mutation and an H840A mutation. Such mutations inactivate both nuclease domains, thereby resulting in the loss of nuclease activity. In other embodiments, a catalytically dead polynucleotide programmable nucleotide binding domain can comprise one or more deletions of all or a portion of a catalytic domain (e.g. RuvC1 and/or HNH domains). In further embodiments, a catalytically dead polynucleotide programmable nucleotide binding domain comprises a point mutation (e.g. D10A or H840A) as well as a deletion of all or a portion of a nuclease domain.

Also contemplated herein are mutations capable of generating a catalytically dead polynucleotide programmable nucleotide binding domain from a previously functional version of the polynucleotide programmable nucleotide binding domain. For example, in the case of catalytically dead Cas9 ("dCas9"), variants having mutations other than D10A and H840A are provided, which result in nuclease inactivated Cas9. Such mutations, by way of example, include other amino acid substitutions at D10 and H840, or other substitutions within the nuclease domains of Cas9 (e.g., substitutions in the HNH nuclease subdomain and/or the RuvC1 subdomain).

Additional suitable nuclease-inactive dCas9 domains can be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference). In some embodiments, the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

Non-limiting examples of a polynucleotide programmable nucleotide binding domain which can be incorporated into a base editor include a CRISPR protein-derived domain, a restriction nuclease, a meganuclease, TAL nuclease (TALEN), and a zinc finger nuclease (ZFN). In some cases, a base editor comprises a polynucleotide programmable nucleotide binding domain comprising a natural or modified protein or portion thereof which via a bound guide nucleic acid is capable of binding to a nucleic acid sequence during CRISPR (i.e., Clustered Regularly Interspaced Short Palindromic Repeats)-mediated modification of a nucleic acid. Such a protein is referred to herein as a "CRISPR protein". Accordingly, disclosed herein is a base editor comprising a polynucleotide programmable nucleotide binding domain comprising all or a portion of a CRISPR protein (i.e. a base editor comprising as a domain all or a portion of a CRISPR protein, also referred to as a "CRISPR protein-derived domain" of the base editor). A CRISPR protein-derived domain incorporated into a base editor can be modified compared to a wild-type or natural version of the CRISPR protein. For example, as described below, a CRISPR protein-derived domain can comprise one or more mutations, insertions, deletions, rearrangements and/or recombinations relative to a wild-type or natural version of the CRISPR protein.

In some embodiments, a CRISPR protein-derived domain incorporated into a base editor is an endonuclease (e.g., deoxyribonuclease or ribonuclease) capable of binding a target polynucleotide when in conjunction with a bound guide nucleic acid. In some embodiments, a CRISPR protein-derived domain incorporated into a base editor is a nickase capable of binding a target polynucleotide when in conjunction with a bound guide nucleic acid. In some embodiments, a CRISPR protein-derived domain incorporated into a base editor is a catalytically dead domain capable of binding a target polynucleotide when in conjunction with a bound guide nucleic acid. In some embodiments, a target polynucleotide bound by a CRISPR protein derived domain of a base editor is DNA. In some embodiments, a target polynucleotide bound by a CRISPR protein-derived domain of a base editor is RNA.

In some embodiments, a CRISPR protein-derived domain of a base editor can include all or a portion of Cas9 from *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquis* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); *Neisseria meningitidis* (NCBI Ref: YP_002342100.1), *Streptococcus pyogenes*, or *Staphylococcus aureus*.

In some embodiments, a Cas9-derived domain of a base editor is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 domain comprises a N579X mutation. In some embodiments, the SaCas9 domain comprises a N579A mutation. In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence. In some embodiments, the SaCas9 domain comprises one or more of a E781X, a N967X, and a R1014X mutation.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises a N579A mutation, or a corresponding mutation in any of the amino acid sequences provided herein.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT or a NNNRRT PAM sequence. In some embodiments, the SaCas9 domain comprises one or more of a E781X, a N967X, and a R1014X mutation, or a corresponding mutation in any of the amino acid sequences provided herein, wherein X is any amino acid. In some embodiments, the SaCas9 domain comprises one or more of a E781K, a N967K, and a R1014H mutation, or one or more corresponding mutation in any of the amino acid sequences provided herein. In some embodiments, the SaCas9 domain comprises a E781K, a N967K, or a R1014H mutation, or corresponding mutations in any of the amino acid sequences provided herein.

A base editor can comprise a domain derived from all or a portion of a Cas9 that is a high fidelity Cas9. In some embodiments, high fidelity Cas9 domains of a base editor are engineered Cas9 domains comprising one or more mutations that decrease electrostatic interactions between the Cas9 domain and the sugar-phosphate backbone of a DNA, relative to a corresponding wild-type Cas9 domain. High fidelity Cas9 domains that have decreased electrostatic interactions with the sugar-phosphate backbone of DNA can have less off-target effects. In some embodiments, the Cas9 domain (e.g., a wild type Cas9 domain) comprises one or more mutations that decrease the association between the Cas9 domain and the sugar-phosphate backbone of a DNA. In some embodiments, a Cas9 domain comprises one or more mutations that decreases the association between the Cas9 domain and the sugar-phosphate backbone of DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, or more.

In some embodiments, the variant Cas protein can be spCas9, spCas9-VRQR, spCas9-VRER, xCas9 (sp), saCas9, saCas9-KKH, spCas9-MQKSER, spCas9-LRKIQK, or spCas9-LRVSQL. An exemplary saCas9 sequence is provided below:

(SEQ ID NO: 100)
KRNYILGLAIGITSVGYGIIDYETRDVIDAGVRLFKEANVENNEGRRSKRG

ARRLKRRRRHRIQRVKKLLFDYNLLTDHSELSGINPYEARVKGLSQKLSEE

EFSAALLHLAKRRGVHNVNEVEEDTGNELSTKEQISRNSKALEEKYVAELQ

LERLKKDGEVRGSINRFKTSDYVKEAKQLLKVQKAYHQLDQSFIDTYIDLL

ETRRTYYEGPGEGSPFGWKDIKEWYEMLMGHCTYFPEELRSVKYAYNADLY

NALNDLNNLVITRDENEKLEYYEKFQIIENVFKQKKKPTLKQIAKEILVNE

EDIKGYRVTSTGKPEFTNLKVYHDIKDITARKEIIENAELLDQIAKILTIY

QSSEDIQEELTNLNSELTQEEIEQISNLKGYTGTHNLSLKAINLILDELWH

TNDNQIAIFNRLKLVPKKVDLSQQKEIPTTLVDDFILSPVVKRSFIQSIKV

INAIIKKYGLPNDIIIELAREKNSKDAQKMINEMQKRNRQTNERIEEIIRT

TGKENAKYLIEKIKLHDMQEGKCLYSLEAIPLEDLLNNPFNYEVDHIIPRS

VSFDNSFNNKVLVKQEENSKKGNRTPFQYLSSSDSKISYETFKKHILNLAK

GKGRISKTKKEYLLEERDINRFSVQKDFINRNLVDTRYATRGLMNLLRSYF

RVNNLDVKVKSINGGFTSFLRRKWKFKKERNKGYKHHAEDALIIANADFIF

KEWKKLDKAKKVMENQMFEEKQAESMPEIETEQEYKEIFITPHQIKHIKDF

```
KDYKYSHRVDKKPNRKLINDTLYSTRKDDKGNTLIVNNLNGLYDKDNDKLK

KLINKSPEKLLMYHHDPQTYQKLKLIMEQYGDEKNPLYKYYEETGNYLTKY

SKKDNGPVIKKIKYYGNKLNAHLDITDDYPNSRNKVVKLSLKPYRFDVYLD

NGVYKFVTVKNLDVIKKENYYEVNSKCYEEAKKLKKISNQAEFIASFYKND

LIKINGELYRVIGVNNDLLNRIEVNMIDITYREYLENMNDKRPPHIIKTIA

SKTQSIKKYSTDILGNLYEVKSKKHPQIIKKG.
```

In the above saCas9 sequence, residue N579, which is underlined and in bold, may be mutated (e.g., to a A579) to yield a SaCas9 nickase.

An exemplary SaCas9n sequence is provided below:

```
                                    (SEQ ID NO: 101)
KRNYILGLDIGITSVGYGIIDYETRDVIDAGVRLFKEANVENNEGRRSKRG

ARRLKRRRRHRIQRVKKLLFDYNLLTDHSELSGINPYEARVKGLSQKLSEE

EFSAALLHLAKRRGVHNVNEVEEDTGNELSTKEQISRNSKALEEKYVAELQ

LERLKKDGEVRGSINRFKTSDYVKEAKQLLKVQKAYHQLDQSFIDTYIDLL

ETRRTYYEGPGEGSPFGWKDIKEWYEMLMGHCTYFPEELRSVKYAYNADLY

NALNDLNNLVITRDENEKLEYYEKFQIIENVFKQKKKPTLKQIAKEILVNE

EDIKGYRVTSTGKPEFTNLKVYHDIKDITARKEIIENAELLDQIAKILTIY

QSSEDIQEELTNLNSELTQEEIEQISNLKGYTGTHNLSLKAINLILDELWH

TNDNQIAIFNRLKLVPKKVDLSQQKEIPTTLVDDFILSPVVKRSFIQSIKV

INAIIKKYGLPNDIIIELAREKNSKDAQKMINEMQKRNRQTNERIEEIIRT

TGKENAKYLIEKIKLHDMQEGKCLYSLEAIPLEDLLNNPFNYEVDHIIPRS

VSEDNSENNKVLVKQEEASKKGNRTPFQYLSSSDSKISYETFKKHILNLAK

GKGRISKTKKEYLLEERDINRFSVQKDFINRNLVDTRYATRGLMNLLRSYF

RVNNLDVKVKSINGGFTSFLRRKWKFKKERNKGYKHHAEDALIIANADFIF

KEWKKLDKAKKVMENQMFEEKQAESMPEIETEQEYKEIFITPHQIKHIKDE

KDYKYSHRVDKKPNRKLINDTLYSTRKDDKGNTLIVNNLNGLYDKDNDKLK

KLINKSPEKLLMYHHDPQTYQKLKLIMEQYGDEKNPLYKYYEETGNYLTKY

SKKDNGPVIKKIKYYGNKLNAHLDITDDYPNSRNKVVKLSLKPYREDVYLD

NGVYKEVTVKNLDVIKKENYYEVNSKCYEEAKKLKKISNQAEFIASFYKND

LIKINGELYRVIGVNNDLLNRIEVNMIDITYREYLENMNDKRPPHIIKTIA

SKTQSIKKYSTDILGNLYEVKSKKHPQIIKKG.
```

In the above SaCas9n sequence, residue A579, which can be mutated from N579 to yield a SaCas9 nickase, is underlined and in bold.

The sequence of an exemplary SaKKH Cas9 is provided below:

```
                                    (SEQ ID NO: 102)
KRNYILGLDIGITSVGYGIIDYETRDVIDAGVRLFKEANVENNEGRRSK

RGARRLKRRRRHRIQRVKKLLFDYNLLTDHSELSGINPYEARVKGLSQK

LSEEEFSAALLHLAKRRGVHNVNEVEEDTGNELSTKEQISRNSKALEEK

YVAELQLERLKKDGEVRGSINRFKTSDYVKEAKQLLKVQKAYHQLDQSF

IDTYIDLLETRRTYYEGPGEGSPFGWKDIKEWYEMLMGHCTYFPEELRS

VKYAYNADLYNALNDLNNLVITRDENEKLEYYEKFQIIENVFKQKKKPT

LKQIAKEILVNEEDIKGYRVTSTGKPEFTNLKVYHDIKDITARKEIIEN

AELLDQIAKILTIYQSSEDIQEELTNLNSELTQEEIEQISNLKGYTGTH

NLSLKAINLILDELWHTNDNQIAIFNRLKLVPKKVDLSQQKEIPTTLVD

DFILSPVVKRSFIQSIKVINAIIKKYGLPNDIIIELAREKNSKDAQKMI

NEMQKRNRQTNERIEEIIRTTGKENAKYLIEKIKLHDMQEGKCLYSLEA

IPLEDLLNNPFNYEVDHIIPRSVSFDNSFNNKVLVKQEEASKKGNRTPF

QYLSSSDSKISYETFKKHILNLAKGKGRISKTKKEYLLEERDINRFSVQ

KDFINRNLVDTRYATRGLMNLLRSYFRVNNLDVKVKSINGGFTSFLRRK

WKFKKERNKGYKHHAEDALIIANADFIFKEWKKLDKAKKVMENQMFEEK

QAESMPEIETEQEYKEIFITPHQIKHIKDFKDYKYSHRVDKKPNRKLIN

DTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYY

GNKLNAHLDITDDYPNSRNKVVKLSLKPYRFDVYLDNGVYKFVTVKNLD

VIKKENYYEVNSKCYEEAKKLKKISNQAEFIASFYKNDLIKINGELYRV

IGVNNDLLNRIEVNMIDITYREYLENMNDKRPPHIIKTIASKTQSIKKY

STDILGNLYEVKSKKHPQIIKKG
```

Residue A579 above, which can be mutated from N579 to yield a SaCas9 nickase, is underlined and in bold. Residues K781, K967, and H1014 above, which can be mutated from E781, N967, and R1014 to yield a SaKKH Cas9 are underlined and in italics.

In some embodiments, the modified Cas9 is a high fidelity Cas9 enzyme. In some embodiments, the high fidelity Cas9 enzyme is SpCas9(K855A), eSpCas9(1.1), SpCas9-HF1, or hyper accurate Cas9 variant (HypaCas9). The modified Cas9 eSpCas9(1.1) contains alanine substitutions that weaken the interactions between the HNH/RuvC groove and the non-target DNA strand, preventing strand separation and cutting at off-target sites. Similarly, SpCas9-HF1 lowers off-target editing through alanine substitutions that disrupt Cas9's interactions with the DNA phosphate backbone. HypaCas9 contains mutations (SpCas9 N692A/M694A/Q695A/H698A) in the REC3 domain that increase Cas9 proofreading and target discrimination. All three high fidelity enzymes generate less off-target editing than wildtype Cas9. An exemplary high fidelity Cas9 is provided below. High Fidelity Cas9 domain mutations relative to Cas9 are shown in bold and underlining.

```
                                    (SEQ ID NO: 103)
MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKERGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG
```

-continued

SIPHQIHLGELHAILRRQEDFYPFLKDNREKIEKILTFRIPYYVGPLARGN

SRFAWMTRKSEETITPWNFEEVVDKGASAQSFIERMTAFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGALS

RKLINGIRDKQSGKTILDFLKSDGFANRNFMALIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

RQLVETRAITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD

Guide Polynucleotides

As used herein, the term "guide polynucleotide(s)" refer to a polynucleotide which can be specific for a target sequence and can form a complex with a polynucleotide programmable nucleotide binding domain protein (e.g., Cas9 or Cpf1). In an embodiment, the guide polynucleotide is a guide RNA. As used herein, the term "guide RNA (gRNA)" and its grammatical equivalents can refer to an RNA which can be specific for a target DNA and can form a complex with Cas protein. An RNA/Cas complex can assist in "guiding" Cas protein to a target DNA. Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gRNA") can be engineered so as to incorporate aspects of both the crRNA and tracrRNA into a single RNA species. See, e.g., Jinek M. et al., Science 337:816-821 (2012), the entire contents of which is hereby incorporated by reference. Cas9 recognizes a short motif in the CRISPR repeat sequences (the PAM or protospacer adjacent motif) to help distinguish "self" versus "non-self." Cas9 nuclease sequences and structures are well known to those of skill in the art (see e.g., "Complete genome sequence of an M1 strain of *Streptococcus pyogenes*." Ferretti, J. J. et al., Natl. Acad. Sci. U.S.A. 98:4658-4663(2001); "CRISPR RNA maturation by trans-encoded small RNA and host factor RNase III." Deltcheva E. et al., Nature 471:602-607(2011); and "Programmable dual-RNA-guided DNA endonuclease in adaptive bacterial immunity." Jinek M. et al, Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences can be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

In some embodiments, the guide polynucleotide is at least one single guide RNA ("sgRNA" or "gRNA"). In some embodiments, the guide polynucleotide is at least one tracrRNA. In some embodiments, the guide polynucleotide does not require PAM sequence to guide the polynucleotide-programmable DNA-binding domain (e.g., Cas9 or Cpf1) to the target nucleotide sequence.

The polynucleotide programmable nucleotide binding domain (e.g., a CRISPR-derived domain) of the base editors disclosed herein can recognize a target polynucleotide sequence by associating with a guide polynucleotide. A guide polynucleotide (e.g., gRNA) is typically single-stranded and can be programmed to site-specifically bind (i.e., via complementary base pairing) to a target sequence of a polynucleotide, thereby directing a base editor that is in conjunction with the guide nucleic acid to the target sequence. A guide polynucleotide can be DNA. A guide polynucleotide can be RNA. In some cases, the guide polynucleotide comprises natural nucleotides (e.g., adenosine). In some cases, the guide polynucleotide comprises non-natural (or unnatural) nucleotides (e.g., peptide nucleic acid or nucleotide analogs). In some cases, the targeting region of a guide nucleic acid sequence can be at least 15, 16, 17, 18, 19, 20, 21, 22, 23, 24, 25, 26, 27, 28, 29, or 30 nucleotides in length. A targeting region of a guide nucleic acid can be between 10-30 nucleotides in length, or between 15-25 nucleotides in length, or between 15-20 nucleotides in length.

In some embodiments, a guide polynucleotide comprises two or more individual polynucleotides, which can interact with one another via, for example, complementary base pairing (e.g. a dual guide polynucleotide). For example, a guide polynucleotide can comprise a CRISPR RNA (crRNA) and a trans-activating CRISPR RNA (tracrRNA). For example, a guide polynucleotide can comprise one or more trans-activating CRISPR RNA (tracrRNA).

In type II CRISPR systems, targeting of a nucleic acid by a CRISPR protein (e.g. Cas9) typically requires complementary base pairing between a first RNA molecule (crRNA) comprising a sequence that recognizes the target sequence and a second RNA molecule (trRNA) comprising repeat sequences which forms a scaffold region that stabilizes the guide RNA-CRISPR protein complex. Such dual guide RNA systems can be employed as a guide polynucleotide to direct the base editors disclosed herein to a target polynucleotide sequence.

In some embodiments, the base editor provided herein utilizes a single guide polynucleotide (e.g., gRNA). In some embodiments, the base editor provided herein utilizes a dual guide polynucleotide (e.g., dual gRNAs). In some embodiments, the base editor provided herein utilizes one or more guide polynucleotide (e.g., multiple gRNA). In some embodiments, a single guide polynucleotide is utilized for different base editors described herein. For example, a single guide polynucleotide can be utilized for a cytidine base editor and an adenosine base editor.

In other embodiments, a guide polynucleotide can comprise both the polynucleotide targeting portion of the nucleic acid and the scaffold portion of the nucleic acid in a single molecule (i.e., a single-molecule guide nucleic acid). For example, a single-molecule guide polynucleotide can be a single guide RNA (sgRNA or gRNA). Herein the term guide polynucleotide sequence contemplates any single, dual or multi-molecule nucleic acid capable of interacting with and directing a base editor to a target polynucleotide sequence.

Typically, a guide polynucleotide (e.g., crRNA/trRNA complex or a gRNA) comprises a "polynucleotide-targeting segment" that includes a sequence capable of recognizing and binding to a target polynucleotide sequence, and a "protein-binding segment" that stabilizes the guide polynucleotide within a polynucleotide programmable nucleotide binding domain component of a base editor. In some embodiments, the polynucleotide targeting segment of the guide polynucleotide recognizes and binds to a DNA polynucleotide, thereby facilitating the editing of a base in DNA. In other cases, the polynucleotide targeting segment of the guide polynucleotide recognizes and binds to an RNA polynucleotide, thereby facilitating the editing of a base in RNA. Herein a "segment" refers to a section or region of a molecule, e.g., a contiguous stretch of nucleotides in the guide polynucleotide. A segment can also refer to a region/section of a complex such that a segment can comprise regions of more than one molecule. For example, where a guide polynucleotide comprises multiple nucleic acid molecules, the protein-binding segment of can include all or a portion of multiple separate molecules that are for instance hybridized along a region of complementarity. In some embodiments, a protein-binding segment of a DNA-targeting RNA that comprises two separate molecules can comprise (i) base pairs 40-75 of a first RNA molecule that is 100 base pairs in length; and (ii) base pairs 10-25 of a second RNA molecule that is 50 base pairs in length. The definition of "segment," unless otherwise specifically defined in a particular context, is not limited to a specific number of total base pairs, is not limited to any particular number of base pairs from a given RNA molecule, is not limited to a particular number of separate molecules within a complex, and can include regions of RNA molecules that are of any total length and can include regions with complementarity to other molecules.

A guide RNA or a guide polynucleotide can comprise two or more RNAs, e.g., CRISPR RNA (crRNA) and transactivating crRNA (tracrRNA). A guide RNA or a guide polynucleotide can sometimes comprise a single-chain RNA, or single guide RNA (sgRNA) formed by fusion of a portion (e.g., a functional portion) of crRNA and tracrRNA. A guide RNA or a guide polynucleotide can also be a dual RNA comprising a crRNA and a tracrRNA. Furthermore, a crRNA can hybridize with a target DNA.

As discussed above, a guide RNA or a guide polynucleotide can be an expression product. For example, a DNA that encodes a guide RNA can be a vector comprising a sequence coding for the guide RNA. A guide RNA or a guide polynucleotide can be transferred into a cell by transfecting the cell with an isolated guide RNA or plasmid DNA comprising a sequence coding for the guide RNA and a promoter. A guide RNA or a guide polynucleotide can also be transferred into a cell in other way, such as using virus-mediated gene delivery.

A guide RNA or a guide polynucleotide can be isolated. For example, a guide RNA can be transfected in the form of an isolated RNA into a cell or organism. A guide RNA can be prepared by in vitro transcription using any in vitro transcription system known in the art. A guide RNA can be transferred to a cell in the form of isolated RNA rather than in the form of plasmid comprising encoding sequence for a guide RNA.

A guide RNA or a guide polynucleotide can comprise three regions: a first region at the 5' end that can be complementary to a target site in a chromosomal sequence, a second internal region that can form a stem loop structure, and a third 3' region that can be single-stranded. A first region of each guide RNA can also be different such that each guide RNA guides a fusion protein to a specific target site. Further, second and third regions of each guide RNA can be identical in all guide RNAs.

A first region of a guide RNA or a guide polynucleotide can be complementary to sequence at a target site in a chromosomal sequence such that the first region of the guide RNA can base pair with the target site. In some cases, a first region of a guide RNA can comprise from or from about 10 nucleotides to 25 nucleotides (i.e., from 10 nucleotides to nucleotides; or from about 10 nucleotides to about 25 nucleotides; or from 10 nucleotides to about 25 nucleotides; or from about 10 nucleotides to 25 nucleotides) or more. For example, a region of base pairing between a first region of a guide RNA and a target site in a chromosomal sequence can be or can be about 10, 11, 12, 13, 14, 15, 16, 17, 18, 19, 20, 22, 23, 24, 25, or more nucleotides in length. Sometimes, a first region of a guide RNA can be or can be about 19, 20, or 21 nucleotides in length.

A guide RNA or a guide polynucleotide can also comprise a second region that forms a secondary structure. For example, a secondary structure formed by a guide RNA can comprise a stem (or hairpin) and a loop. A length of a loop and a stem can vary. For example, a loop can range from or from about 3 to 10 nucleotides in length, and a stem can range from or from about 6 to 20 base pairs in length. A stem can comprise one or more bulges of 1 to 10 or about 10 nucleotides. The overall length of a second region can range from or from about 16 to 60 nucleotides in length. For example, a loop can be or can be about 4 nucleotides in length and a stem can be or can be about 12 base pairs.

A guide RNA or a guide polynucleotide can also comprise a third region at the 3' end that can be essentially single-stranded. For example, a third region is sometimes not complementary to any chromosomal sequence in a cell of interest and is sometimes not complementary to the rest of a guide RNA. Further, the length of a third region can vary. A third region can be more than or more than about 4 nucleotides in length. For example, the length of a third region can range from or from about 5 to 60 nucleotides in length.

A guide RNA or a guide polynucleotide can target any exon or intron of a gene target. In some cases, a guide can target exon 1 or 2 of a gene; in other cases, a guide can target exon 3 or 4 of a gene. A composition can comprise multiple guide RNAs that all target the same exon or, in some cases, multiple guide RNAs that can target different exons. An exon and an intron of a gene can be targeted.

A guide RNA or a guide polynucleotide can target a nucleic acid sequence of or of about 20 nucleotides. A target nucleic acid can be less than or less than about 20 nucleotides. A target nucleic acid can be at least or at least about 5, 10, 15, 16, 17, 18, 19, 20, 21, 22, 23, 24, 25, 30, or anywhere between 1-100 nucleotides in length. A target nucleic acid can be at most or at most about 5, 10, 15, 16, 17, 18, 19, 20, 21, 22, 23, 24, 25, 30, 40, 50, or anywhere between 1-100 nucleotides in length. A target nucleic acid sequence can be or can be about 20 bases immediately 5' of the first nucleotide of the PAM. A guide RNA can target a nucleic acid sequence. A target nucleic acid can be at least or at least about 1-10, 1-20, 1-30, 1-40, 1-50, 1-60, 1-70, 1-80, 1-90, or 1-100 nucleotides.

A guide polynucleotide, for example, a guide RNA, can refer to a nucleic acid that can hybridize to another nucleic acid, for example, the target nucleic acid or protospacer in a genome of a cell. A guide polynucleotide can be RNA. A guide polynucleotide can be DNA. The guide polynucleotide can be programmed or designed to bind to a sequence of nucleic acid site-specifically. A guide polynucleotide can comprise a polynucleotide chain and can be called a single guide polynucleotide. A guide polynucleotide can comprise two polynucleotide chains and can be called a double guide polynucleotide. A guide RNA can be introduced into a cell or embryo as an RNA molecule. For example, a RNA molecule can be transcribed in vitro and/or can be chemically synthesized. An RNA can be transcribed from a synthetic DNA molecule, e.g., a gBlocks® gene fragment. A guide RNA can then be introduced into a cell or embryo as an RNA molecule. A guide RNA can also be introduced into a cell or embryo in the form of a non-RNA nucleic acid molecule, e.g., DNA molecule. For example, a DNA encoding a guide RNA can be operably linked to promoter control sequence for expression of the guide RNA in a cell or embryo of interest. A RNA coding sequence can be operably linked to a promoter sequence that is recognized by RNA polymerase III (Pol III). Plasmid vectors that can be used to express guide RNA include, but are not limited to, px330 vectors and px333 vectors. In some cases, a plasmid vector (e.g., px333 vector) can comprise at least two guide RNA-encoding DNA sequences.

Methods for selecting, designing, and validating guide polynucleotides, e.g. guide RNAs and targeting sequences are described herein and known to those skilled in the art. For example, to minimize the impact of potential substrate promiscuity of a deaminase domain in the nucleobase editor system (e.g., an AID domain), the number of residues that could unintentionally be targeted for deamination (e.g., off-target C residues that could potentially reside on ssDNA within the target nucleic acid locus) may be minimized. In addition, software tools can be used to optimize the gRNAs corresponding to a target nucleic acid sequence, e.g., to minimize total off-target activity across the genome. For example, for each possible targeting domain choice using *S. pyogenes* Cas9, all off-target sequences (preceding selected PAMs, e.g. NAG or NGG) may be identified across the genome that contain up to certain number (e.g., 1, 2, 3, 4, 5, 6, 7, 8, 9, or 10) of mismatched base-pairs. First regions of gRNAs complementary to a target site can be identified, and all first regions (e.g. crRNAs) can be ranked according to its total predicted off-target score; the top-ranked targeting domains represent those that are likely to have the greatest on-target and the least off-target activity. Candidate targeting gRNAs can be functionally evaluated by using methods known in the art and/or as set forth herein.

As a non-limiting example, target DNA hybridizing sequences in crRNAs of a guide RNA for use with Cas9s may be identified using a DNA sequence searching algorithm. gRNA design may be carried out using custom gRNA design software based on the public tool cas-offinder as described in Bae S., Park J., & Kim J.-S. Cas-OFFinder: A fast and versatile algorithm that searches for potential off-target sites of Cas9 RNA-guided endonucleases. Bioinformatics 30, 1473-1475 (2014). This software scores guides after calculating their genome-wide off-target propensity. Typically matches ranging from perfect matches to 7 mismatches are considered for guides ranging in length from 17 to 24. Once the off-target sites are computationally-determined, an aggregate score is calculated for each guide and summarized in a tabular output using a web-interface. In addition to identifying potential target sites adjacent to PAM sequences, the software also identifies all PAM adjacent sequences that differ by 1, 2, 3 or more than 3 nucleotides from the selected target sites. Genomic DNA sequences for a target nucleic acid sequence, e.g. a target gene may be obtained and repeat elements may be screened using publically available tools, for example, the RepeatMasker program. RepeatMasker searches input DNA sequences for repeated elements and regions of low complexity. The output is a detailed annotation of the repeats present in a given query sequence.

Following identification, first regions of guide RNAs, e.g. crRNAs, may be ranked into tiers based on their distance to the target site, their orthogonality and presence of 5' nucleotides for close matches with relevant PAM sequences (for example, a 5' G based on identification of close matches in the human genome containing a relevant PAM e.g., NGG PAM for *S. pyogenes*, NNGRRT or NNGRRV PAM for *S. aureus*). As used herein, orthogonality refers to the number of sequences in the human genome that contain a minimum number of mismatches to the target sequence. A "high level of orthogonality" or "good orthogonality" may, for example, refer to 20-mer targeting domains that have no identical sequences in the human genome besides the intended target, nor any sequences that contain one or two mismatches in the target sequence. Targeting domains with good orthogonality may be selected to minimize off-target DNA cleavage.

In some embodiments, a reporter system may be used for detecting base-editing activity and testing candidate guide polynucleotides. In some embodiments, a reporter system may comprise a reporter gene based assay where base editing activity leads to expression of the reporter gene. For example, a reporter system may include a reporter gene comprising a deactivated start codon, e.g., a mutation on the template strand from 3'-TAC-5' to 3'-CAC-5'. Upon successful deamination of the target C, the corresponding mRNA will be transcribed as 5'-AUG-3' instead of 5'-GUG-3', enabling the translation of the reporter gene. Suitable reporter genes will be apparent to those of skill in the art. Non-limiting examples of reporter genes include gene encoding green fluorescence protein (GFP), red fluorescence protein (RFP), luciferase, secreted alkaline phosphatase (SEAP), or any other gene whose expression are detectable and apparent to those skilled in the art. The reporter system can be used to test many different gRNAs, e.g., in order to determine which residue(s) with respect to the target DNA sequence the respective deaminase will target. sgRNAs that target non-template strand can also be tested in order to assess off-target effects of a specific base editing protein, e.g. a Cas9 deaminase fusion protein. In some embodiments, such gRNAs can be designed such that the mutated start codon will not be base-paired with the gRNA. The guide polynucleotides can comprise standard ribonucleotides, modified ribonucleotides (e.g., pseudouridine), ribonucleotide isomers, and/or ribonucleotide analogs. In some embodiments, the guide polynucleotide can comprise at least one detectable label. The detectable label can be a fluorophore (e.g., FAM, TMR, Cy3, Cy5, Texas Red, Oregon Green, Alexa Fluors, Halo tags, or suitable fluorescent dye), a detection tag (e.g., biotin, digoxigenin, and the like), quantum dots, or gold particles.

The guide polynucleotides can be synthesized chemically, synthesized enzymatically, or a combination thereof. For example, the guide RNA can be synthesized using standard phosphoramidite-based solid-phase synthesis methods. Alternatively, the guide RNA can be synthesized in vitro by operably linking DNA encoding the guide RNA to a promoter control sequence that is recognized by a phage RNA polymerase. Examples of suitable phage promoter sequences include T7, T3, SP6 promoter sequences, or variations thereof. In embodiments in which the guide RNA comprises two separate molecules (e.g., crRNA and tracrRNA), the crRNA can be chemically synthesized and the tracrRNA can be enzymatically synthesized.

In some embodiments, a base editor system may comprise multiple guide polynucleotides, e.g. gRNAs. For example, the gRNAs may target to one or more target loci (e.g., at least 1 gRNA, at least 2 gRNA, at least 5 gRNA, at least 10 gRNA, at least 20 gRNA, at least 30 g RNA, at least 50 gRNA) comprised in a base editor system. Said multiple gRNA sequences can be tandemly arranged and are preferably separated by a direct repeat.

A DNA sequence encoding a guide RNA or a guide polynucleotide can also be part of a vector. Further, a vector can comprise additional expression control sequences (e.g., enhancer sequences, Kozak sequences, polyadenylation sequences, transcriptional termination sequences, etc.), selectable marker or reporter sequences (e.g., GFP or antibiotic resistance genes such as puromycin), origins of replication, and the like. A DNA molecule encoding a guide RNA can also be linear. A DNA molecule encoding a guide RNA or a guide polynucleotide can also be circular.

In some embodiments, one or more components of a base editor system may be encoded by DNA sequences. Such DNA sequences may be introduced into an expression system, e.g. a cell, together or separately. For example, DNA sequences encoding a polynucleotide programmable nucleotide binding domain and a guide RNA may be introduced into a cell, each DNA sequence can be part of a separate molecule (e.g., one vector containing the polynucleotide programmable nucleotide binding domain coding sequence and a second vector containing the guide RNA coding sequence) or both can be part of a same molecule (e.g., one vector containing coding (and regulatory) sequence for both the polynucleotide programmable nucleotide binding domain and the guide RNA).

When DNA sequences encoding an RNA-guided endonuclease and a guide RNA are introduced into a cell, each DNA sequence can be part of a separate molecule (e.g., one vector containing an RNA-guided endonuclease coding sequence and a second vector containing a guide RNA coding sequence) or both can be part of a same molecule (e.g., one vector containing coding (and regulatory) sequences for both an RNA-guided endonuclease and a guide RNA).

A guide polynucleotide can comprise one or more modifications to provide a nucleic acid with a new or enhanced feature. A guide polynucleotide can comprise a nucleic acid affinity tag. A guide polynucleotide can comprise synthetic nucleotide, synthetic nucleotide analog, nucleotide derivatives, and/or modified nucleotides.

In some cases, a gRNA or a guide polynucleotide can comprise modifications. A modification can be made at any location of a gRNA or a guide polynucleotide. More than one modification can be made to a single gRNA or a guide polynucleotide. A gRNA or a guide polynucleotide can undergo quality control after a modification. In some cases, quality control can include PAGE, HPLC, MS, or any combination thereof.

A modification of a gRNA or a guide polynucleotide can be a substitution, insertion, deletion, chemical modification, physical modification, stabilization, purification, or any combination thereof.

A gRNA or a guide polynucleotide can also be modified by 5'adenylate, 5' guanosine-triphosphate cap, 5'N7-Methylguanosine-triphosphate cap, 5'triphosphate cap, 3'phosphate, 3'thiophosphate, 5'phosphate, 5'thiophosphate, Cis-Syn thymidine dimer, trimers, C12 spacer, C3 spacer, C6 spacer, dSpacer, PC spacer, rSpacer, Spacer 18, Spacer 9,3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3'DABCYL, black hole quencher 1, black hole quencer 2, DABCYL SE, dT-DABCYL, IRDye QC-1, QSY-21, QSY-35, QSY-7, QSY-9, carboxyl linker, thiol linkers, 2'-deoxyribonucleoside analog purine, 2'-deoxyribonucleoside analog pyrimidine, ribonucleoside analog, 2'-O-methyl ribonucleoside analog, sugar modified analogs, wobble/universal bases, fluorescent dye label, 2'-fluoro RNA, 2'-O-methyl RNA, methylphosphonate, phosphodiester DNA, phosphodiester RNA, phosphothioate DNA, phosphorothioate RNA, UNA, pseudouridine-5'-triphosphate, 5'-methylcytidine-5'-triphosphate, or any combination thereof.

In some cases, a modification is permanent. In other cases, a modification is transient. In some cases, multiple modifications are made to a gRNA or a guide polynucleotide. A gRNA or a guide polynucleotide modification can alter physiochemical properties of a nucleotide, such as their conformation, polarity, hydrophobicity, chemical reactivity, base-pairing interactions, or any combination thereof.

A modification can also be a phosphorothioate substitute. In some cases, a natural phosphodiester bond can be susceptible to rapid degradation by cellular nucleases and; a modification of internucleotide linkage using phosphorothioate (PS) bond substitutes can be more stable toward hydrolysis by cellular degradation. A modification can increase stability in a gRNA or a guide polynucleotide. A modification can also enhance biological activity. In some cases, a phosphorothioate enhanced RNA gRNA can inhibit RNase A, RNase T1, calf serum nucleases, or any combinations thereof. These properties can allow the use of PS-RNA gRNAs to be used in applications where exposure to nucleases is of high probability in vivo or in vitro. For example, phosphorothioate (PS) bonds can be introduced between the last 3-5 nucleotides at the 5'- or "-end of a gRNA which can inhibit exonuclease degradation. In some cases, phosphorothioate bonds can be added throughout an entire gRNA to reduce attack by endonucleases.

Protospacer Adjacent Motif

The "protospacer adjacent motif (PAM)" or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer).

The protospacer adjacent motif (PAM) or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer). The PAM sequence is essential for target binding, but the exact sequence depends on a type of Cas protein.

A base editor provided herein can comprise a CRISPR protein-derived domain that is capable of binding a nucleotide sequence that contains a canonical or non-canonical protospacer adjacent motif (PAM) sequence. A PAM site is a nucleotide sequence in proximity to a target polynucleotide sequence. Some aspects of the disclosure provide for base editors comprising all or a portion of CRISPR proteins that have different PAM specificities. For example, Cas9 proteins, such as Cas9 from *S. pyogenes* (spCas9), typically require a canonical NGG PAM sequence to bind a particular nucleic acid region, where the "N" in "NGG" is adenine (A), thymine (T), guanine (G), or cytosine (C), and the G is guanine. A PAM can be CRISPR protein-specific and can be different between different base editors comprising different CRISPR protein-derived domains. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length.

Cas9 Protein Sequences

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9XD9X mutation, or a corresponding mutation in any of the amino acid sequences provided herein, wherein X is amino acid except for D. In some embodiments, the SpCas9 comprises a D9AD9A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence. In some embodiments, the SpCas9 domain comprises one or more of a D1135X, a R1335X, and a T1337X mutation, or a corresponding mutation mutation in any of the amino acid sequences provided herein herein, wherein X is any amino acid. In some embodiments, the SpCas9 domain comprises one or more of a D1135E, R1335Q, and T1337R mutation, or a corresponding mutation in any of the amino acid sequences provided herein. In some embodiments, the SpCas9 domain comprises a D1135E, a R1335Q, and a T1337R mutation, or corresponding mutations in any of the amino sequences provided herein. In some embodiments, the SpCas9 domain domain comprises one or more of a D1135X, a R1335X, and a T1337X mutation, or a corresponding mutation in any of the amino acid sequences provided herein herein, wherein X is any amino acid. In some embodiments, the SpCas9 domain comprises one or more of a D1135V, a R1335Q, and a T1337R mutation, or a corresponding mutation in any of the amino acid sequences provided herein. In some embodiments, the SpCas9 domain comprises a D1135V, a R1335Q, and a T1337R mutation, or corresponding mutations in any of the amino acid sequences provided herein. In some embodiments, the SpCas9SpCas9 domain comprises one or more of a D1135X, a G1218X, a R1335X, and a T1337X mutation, or a corresponding mutation in any of the amino acid sequences provided herein, wherein X is any amino acid. In some embodiments, the SpCas9 domain comprises one or more of a D1135V, a G1218R, a R1335Q, and a T1337R mutation, or a corresponding mutation in any of the amino sequences provided herein. In some embodiments, the SpCas9 In some embodiments, the SpCas9 domain comprises a D1135V, a G1218R, a R1335Q, and a T1337R mutation, or corresponding mutations in any of the amino acid sequences provided herein herein.

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

The following provides an exemplary SpCas9 sequence:

(SEQ ID NO: 82)
MDKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTEDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFEKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

```
FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD
```

The following provides an exemplary SpCas9n sequence:

```
                                    (SEQ ID NO: 84)
MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFEHRLE

ESELVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTEDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFEKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD
```

The following provides an exemplary SpEQR Cas9 sequence:

```
                                    (SEQ ID NO: 104)
MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFESPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKQYRSTKEVLDATLIHQSITGLYETRIDLSQLGGD.
```

In the above SpEQR Cas9 sequence, residues E1135, Q1335 and R1337, which can be mutated from D1135, R1335, and T1337 to yield a SpEQR Cas9, are underlined and in bold.

The following provides and exemplary SpVQR Cas9 sequence:

```
                                    (SEQ ID NO: 105)
MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN
```

-continued

```
ASLGTYHDLLKIIKDKDFLDNEENEDILEDIVLTLTLFEDREMIEERLK
TYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKK
GILQTVKVVDELVKVMGRHKPENIVIEMARENQTTQKGQKNSRERMKRI
EEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNY
WRQLLNAKLITQRKFDNLTKAERGGLSELDKAGFIKRQLVETRQITKHV
AQILDSRMNTKYDENDKLIREVKVITLKSKLVSDFRKDFQFYKVREINN
YHHAHDAYLNAVVGTALIKKYPKLESEFVYGDYKVYDVRKMIAKSEQEI
GKATAKYFFYSNIMNFFKTEITLANGEIRKRPLIETNGETGEIVWDKGR
DFATVRKVLSMPQVNIVKKTEVQTGGFSKESILPKRNSDKLIARKKDWD
PKKYGGFVSPTVAYSVLVVAKVEKGKSKKLKSVKELLGITIMERSSFEK
NPIDFLEAKGYKEVKKDLIIKLPKYSLFELENGRKRMLASAGELQKGNE
LALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAA
FKYFDTTIDRKQYRSTKEVLDATLIHQSITGLYETRIDLSQLGGD.
```

In the above SpVQR Cas9 sequence, residues V1135, Q1335, and R1337, which can be mutated from D1135, R1335, and T1337 to yield a SpVQR Cas9, are underlined and in bold.

The following provides an exemplary SpVRER Cas9 sequence:

```
                                        (SEQ ID NO: 106)
MDKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFEIRL
EESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINA
SGVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSDI
LRVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTEDN
GSIPHQIHLGELHAILRRQEDFYPFLKDNREKIEKILTFRIPYYVGPLARG
NSRFAWMTRKSEETITPWNFEEVVDKGASAQSFIERMTNFDKNLPNEKVLP
KHSLLYEYFTVYNELTKVKYVTEGMRKPAFLSGEQKKAIVDLLEKTNRKVT
VKQLKEDYFKKIECEDSVEISGVEDRFNASLGTYHDLLKIIKDKDFLDNEE
NEDILEDIVLTLTLFEDREMIEERLKTYAHLFDDKVMKQLKRRRYTGWGRL
SRKLINGIRDKQSGKTILDFLKSDGFANRNFMQLIHDDSLTFKEDIQKAQV
SGQGDSLHEHIANLAGSPAIKKGILQTVKVVDELVKVMGRHKPENIVIEMA
RENQTTQKGQKNSRERMKRIEEGIKELGSQILKEHPVENTQLQNEKLYLYY
LQNGRDMYVDQELDINRLSDYDVDHIVPQSFLKDDSIDNKVLTRSDKNRGK
SDNVPSEEVVKKMKNYWRQLLNAKLITQRKFDNLTKAERGGLSELDKAGFI
KRQLVETRQITKHVAQILDSRMNTKYDENDKLIREVKVITLKSKLVSDFRK
DFQFYKVREINNYHHAHDAYLNAVVGTALIKKYPKLESEFVYGDYKVYDVR
KMIAKSEQEIGKATAKYFFYSNIMNFEKTEITLANGEIRKRPLIETNGETG
EIVWDKGRDFATVRKVLSMPQVNIVKKTEVQTGGFSKESILPKRNSDKLIA
RKKDWDPKKYGGFVSPTVAYSVLVVAKVEKGKSKKLKSVKELLGITIMERS
SFEKNPIDFLEAKGYKEVKKDLIIKLPKYSLFELENGRKRMLASARELQKG
NELALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAAFK
YFDTTIDRKEYRSTKEVLDATLIHQSITGLYETRIDLSQLGGD.
```

The following provides an exemplary SpVRQR Cas9 sequence:

```
                                        (SEQ ID NO: 107)
MDKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFEIRL
EESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINA
SGVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSDI
LRVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTEDN
GSIPHQIHLGELHAILRRQEDFYPFLKDNREKIEKILTFRIPYYVGPLARG
NSRFAWMTRKSEETITPWNFEEVVDKGASAQSFIERMTNFDKNLPNEKVLP
KHSLLYEYFTVYNELTKVKYVTEGMRKPAFLSGEQKKAIVDLLEKTNRKVT
VKQLKEDYFKKIECEDSVEISGVEDRFNASLGTYHDLLKIIKDKDFLDNEE
NEDILEDIVLTLTLFEDREMIEERLKTYAHLFDDKVMKQLKRRRYTGWGRL
SRKLINGIRDKQSGKTILDFLKSDGFANRNFMQLIHDDSLTFKEDIQKAQV
SGQGDSLHEHIANLAGSPAIKKGILQTVKVVDELVKVMGRHKPENIVIEMA
RENQTTQKGQKNSRERMKRIEEGIKELGSQILKEHPVENTQLQNEKLYLYY
LQNGRDMYVDQELDINRLSDYDVDHIVPQSFLKDDSIDNKVLTRSDKNRGK
SDNVPSEEVVKKMKNYWRQLLNAKLITQRKFDNLTKAERGGLSELDKAGFI
KRQLVETRQITKHVAQILDSRMNTKYDENDKLIREVKVITLKSKLVSDFRK
DFQFYKVREINNYHHAHDAYLNAVVGTALIKKYPKLESEFVYGDYKVYDVR
KMIAKSEQEIGKATAKYFFYSNIMNFEKTEITLANGEIRKRPLIETNGETG
EIVWDKGRDFATVRKVLSMPQVNIVKKTEVQTGGFSKESILPKRNSDKLIA
RKKDWDPKKYGGFVSPTVAYSVLVVAKVEKGKSKKLKSVKELLGITIMERS
SFEKNPIDFLEAKGYKEVKKDLIIKLPKYSLFELENGRKRMLASARELQKG
NELALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAAFK
YFDTTIDRKQYRSTKEVLDATLIHQSITGLYETRIDLSQLGGD.
```

Residues V1135, R1218, Q1335, and R1337 above, which can be mutated from D1135, G1218, R1335, and T1337 to yield a SpVRQR Cas9, are underlined and in bold.

In some embodiments, the Cas9 domain is a recombinant Cas9 domain. In some embodiments, the recombinant Cas9 domain is a SpyMacCas9 domain. In some embodiments, the SpyMacCas9 domain is a nuclease active SpyMacCas9, a nuclease inactive SpyMacCas9 (SpyMacCas9d), or a SpyMacCas9 nickase (SpyMacCas9n). In some embodiments, the SaCas9 domain, the SaCas9d domain, or the SaCas9n domain can bind to a nucleic acid sequence having a non-canonical PAM. In some embodiments, the SpyMacCas9 domain, the SpCas9d domain, or the SpCas9n domain can bind to a nucleic acid sequence having a NAA PAM sequence.

Exemplary SpyMacCas9
(SEQ ID NO: 108)
MDKKYSIGLDIGTNSVGWAVITDDYKVPSKKFKVLGNTDRHSIKKNLIGAL

LFGSGETAEATRLKRTARRRYTRRKNRICYLQEIFSNEMAKVDDSFFHRLE

ESFLVEEDKKHERHPIFGNIVDEVAYHEKYPTIYHLRKKLADSTDKADLRL

IYLALAHMIKFRGHFLIEGDLNPDNSDVDKLFIQLVQIYNQLFEENPINAS

RVDAKAILSARLSKSRRLENLIAQLPGEKRNGLFGNLIALSLGLTPNFKSN

FDLAEDAKLQLSKDTYDDDLDNLLAQIGDQYADLFLAAKNLSDAILLSDIL

RVNSEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGAYHDLLKIIKDKDFLDNEEN

EDILEDIVLTLTLFEDRGMIEERLKTYAHLFDDKVMKQLKRRRYTGWGRLS

RKLINGIRDKQSGKTILDFLKSDGFANRNFMQLIHDDSLTFKEDIQKAQVS

GQGHSLHEQIANLAGSPAIKKGILQTVKIVDELVKVMGHKPENIVIEMARE

NQTTQKGQKNSRERMKRIEEGIKELGSQILKEHPVENTQLQNEKLYLYYLQ

NGRDMYVDQELDINRLSDYDVDHIVPQSFIKDDSIDNKVLTRSDKNRGKSD

NVPSEEVVKKMKNYWRQLLNAKLITQRKFDNLTKAERGGLSELDKAGFIKR

QLVETRQITKHVAQILDSRMNTKYDENDKLIREVKVITLKSKLVSDFRKDF

QFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEI

VWDKGRDFATVRKVLSMPQVNIVKKTEIQTVGQNGGLFDDNPKSPLEVTPS

KLVPLKKELNPKKYGGYQKPTTAYPVLLITDTKQLIPISVMNKKQFEQNPV

KFLRDRGYQQVGKNDFIKLPKYTLVDIGDGIKRLWASSKEIHKGNQLVVSK

KSQILLYHAHHLDSDLSNDYLQNHNQQFDVLFNEIISFSKKCKLGKEHIQK

IENVYSNKKNSASIEELAESFIKLLGFTQLGATSPFNFLGVKLNQKQYKGK

KDYILPCTEGTLIRQSITGLYETRVDLSKIGED.

High Fidelity Cas9 Domains

Some aspects of the disclosure provide high fidelity Cas9 domains. In some embodiments, high fidelity Cas9 domains are engineered Cas9 domains comprising one or more mutations that decrease electrostatic interactions between the Cas9 domain and a sugar-phosphate backbone of a DNA, as compared to a corresponding wild-type Cas9 domain. Without wishing to be bound by any particular theory, high fidelity Cas9 domains that have decreased electrostatic interactions with a sugar-phosphate backbone of DNA may have less off-target effects. In some embodiments, a Cas9 domain (e.g., a wild type Cas9 domain) comprises one or more mutations that decreases the association between the Cas9 domain and a sugar-phosphate backbone of a DNA. In some embodiments, a Cas9 domain comprises one or more mutations that decreases the association between the Cas9 domain and a sugar-phosphate backbone of a DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, or at least 70%.

In some embodiments, any of the Cas9 fusion proteins provided herein comprise one or more of a N497X, a R661X, a Q695X, and/or a Q926X mutation, or a corresponding mutation in any of the amino acid sequences provided herein, wherein X is any amino acid. In some embodiments, any of the Cas9 fusion proteins provided herein comprise one or more of a N497A, a R661A, a Q695A, and/or a Q926A mutation, or a corresponding mutation in any of the amino acid sequences provided herein. In some embodiments, the Cas9 domain comprises a D10A mutation, or a corresponding mutation in any of the amino acid sequences provided herein. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." *Nature* 529, 490-495 (2016); and Slaymaker, I. M., et al. "Rationally engineered Cas9 nucleases with improved specificity." *Science* 351, 84-88 (2015); the entire contents of each are incorporated herein by reference. In the below High Fidelity Cas9 domain, mutations relative to Cas9 are shown in bold and underlining.

(SEQ ID NO: 103)
MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTAFDKNLPNEKVLPK

HSLLYEYFTVYNELTKVKYVTEGMRKPAFLSGEQKKAIVDLLEKTNRKVTV

KQLKEDYFKKIECEDSVEISGVEDRFNASLGTYHDLLKIIKDKDFLDNEEN

EDILEDIVLTLTLFEDREMIEERLKTYAHLFDDKVMKQLKRRRYTGWGALS

RKLINGIRDKQSGKTILDFLKSDGFANRNFMALIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

```
-continued
RQLVETRAITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD
```

In some cases, a variant Cas9 protein harbors, H840A, P475A, W476A, N477A, D1125A, W1126A, and D1127A mutations such that the polypeptide has a reduced ability to cleave a target DNA or RNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some cases, when a variant Cas9 protein harbors W476A and W1126A mutations or when the variant Cas9 protein harbors P475A, W476A, N477A, D1125A, W1126A, and D1127A mutations, the variant Cas9 protein does not bind efficiently to a PAM sequence. Thus, in some such cases, when such a variant Cas9 protein is used in a method of binding, the method does not require a PAM sequence. In other words, in some cases, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a CRISPR protein-derived domain of a base editor can comprise all or a portion of a Cas9 protein with a canonical PAM sequence (NGG). In other embodiments, a Cas9-derived domain of a base editor can employ a non-canonical PAM sequence. Such sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature, 523, 481-485 (2015); and Kleinstiver, B. P., et al., "Broadening the targeting range of *Staphylococcus aureus* CRISPR-Cas9 by modifying PAM recognition" Nature Biotechnology, 33, 1293-1298 (2015); the entire contents of each are hereby incorporated by reference.

In some examples, a PAM recognized by a CRISPR protein-derived domain of a base editor disclosed herein can be provided to a cell on a separate oligonucleotide to an insert (e.g. an AAV insert) encoding the base editor. In such cases, providing PAM on a separate oligonucleotide can allow cleavage of a target sequence that otherwise would not be able to be cleaved, because no adjacent PAM is present on the same polynucleotide as the target sequence.

In an embodiment, *S. pyogenes* Cas9 (SpCas9) can be used as a CRISPR endonuclease for genome engineering. However, others can be used. In some cases, a different endonuclease can be used to target certain genomic targets. In some cases, synthetic SpCas9-derived variants with non-NGG PAM sequences can be used. Additionally, other Cas9 orthologues from various species have been identified and these "non-SpCas9s" can bind a variety of PAM sequences that can also be useful for the present disclosure. For example, the relatively large size of SpCas9 (approximately 4 kb coding sequence) can lead to plasmids carrying the SpCas9 cDNA that cannot be efficiently expressed in a cell. Conversely, the coding sequence for *Staphylococcus aureus* Cas9 (SaCas9) is approximately 1 kilo base shorter than SpCas9, possibly allowing it to be efficiently expressed in a cell. Similar to SpCas9, the SaCas9 endonuclease is capable of modifying target genes in mammalian cells in vitro and in mice in vivo. In some cases, a Cas protein can target a different PAM sequence. In some cases, a target gene can be adjacent to a Cas9 PAM, 5'-NGG, for example. In other cases, other Cas9 orthologs can have different PAM requirements. For example, other PAMs such as those of *S. thermophilus* (5'-NNAGAA for CRISPR1 and 5'-NGGNG for CRISPR3) and *Neisseria* meningiditis (5'-NNNNGAT) can also be found adjacent to a target gene.

In some embodiments, for a *S. pyogenes* system, a target gene sequence can precede (i.e., be 5' to) a 5'-NGG PAM, and a 20-nt guide RNA sequence can base pair with an opposite strand to mediate a Cas9 cleavage adjacent to a PAM. In some cases, an adjacent cut can be or can be about 3 base pairs upstream of a PAM. In some cases, an adjacent cut can be or can be about 10 base pairs upstream of a PAM. In some cases, an adjacent cut can be or can be about 0-20 base pairs upstream of a PAM. For example, an adjacent cut can be next to, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 base pairs upstream of a PAM. An adjacent cut can also be downstream of a PAM by 1 to 30 base pairs.

Fusion Proteins Comprising a Nuclear Localization Sequence (NLS)

In some embodiments, the fusion proteins provided herein further comprise one or more (e.g., 2, 3, 4, 5) nuclear targeting sequences, for example a nuclear localization sequence (NLS). In one embodiment, a bipartite NLS is used. In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the Cas9 domain. In some embodiments, the NLS is fused to the C-terminus of an nCas9 domain or a dCas9 domain. In some embodiments, the NLS is fused to the N-terminus of the deaminase. In some embodiments, the NLS is fused to the C-terminus of the deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, an NLS comprises the amino acid sequence PKKKRKVEGADKRTADGSEFES PKKKRKV (SEQ ID NO: 109), KRTADGSEFESPKKKRKV (SEQ ID NO: 71), KRPAATKKAGQAKKKK (SEQ ID NO: 72), KKTELQTTNAENKTKKL (SEQ ID NO: 73), KRGINDRNFWRGENGRKTR (SEQ ID NO: 74), RKSGKIAAIVVKRPRKPKKKRKV (SEQ ID NO: 110), or MDSLLMNRRKFLYQFKNVRWAKGRRETYLC (SEQ ID NO: 77). In some embodiments, the NLS is present in a linker or the NLS is flanked by linkers, for example, the linkers described herein. In some embodiments, the N-terminus or C-terminus NLS is a bipartite NLS. A bipartite NLS comprises two basic amino acid clusters, which are separated by a relatively short spacer sequence (hence bipartite—2 parts, while monopartite NLSs are not). The NLS of nucleoplasmin, KR[PAATKKAGQA]KKKK (SEQ ID NO: 111), is the prototype of the ubiquitous bipartite signal: two clusters of basic amino acids, separated by a spacer of about 10 amino acids. The sequence of an exemplary bipartite NLS follows:

(SEQ ID NO: 109)
PKKKRKVEGADKRTADGSEFES PKKKRKV.

In some embodiments, the fusion proteins of the invention do not comprise a linker sequence. In some embodiments, linker sequences between one or more of the domains or proteins are present.

It should be appreciated that the fusion proteins of the present disclosure may comprise one or more additional features. For example, in some embodiments, the fusion protein may comprise inhibitors, cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

A vector that encodes a CRISPR enzyme comprising one or more nuclear localization sequences (NLSs) can be used. For example, there can be or be about 1, 2, 3, 4, 5, 6, 7, 8, 9, 10 NLSs used. A CRISPR enzyme can comprise the NLSs at or near the amino-terminus, about or more than about 1, 2, 3, 4, 5, 6, 7, 8, 9, 10 NLSs at or near the carboxy-terminus, or any combination of these (e.g., one or more NLS at the amino-terminus and one or more NLS at the carboxy terminus). When more than one NLS is present, each can be selected independently of others, such that a single NLS can be present in more than one copy and/or in combination with one or more other NLSs present in one or more copies.

CRISPR enzymes used in the methods can comprise about 6 NLSs. An NLS is considered near the N- or C-terminus when the nearest amino acid to the NLS is within about 50 amino acids along a polypeptide chain from the N- or C-terminus, e.g., within 1, 2, 3, 4, 5, 10, 15, 20, 25, 30, 40, or 50 amino acids.

In some embodiments, the NLS is present in a linker or the NLS is flanked by linkers, for example, the linkers described herein. In some embodiments, the N-terminus or C-terminus NLS is a bipartite NLS. A bipartite NLS comprises two basic amino acid clusters, which are separated by a relatively short spacer sequence (hence bipartite—2 parts, while monopartite NLSs are not). The NLS of nucleoplasmin, KR[PAATKKAGQA]KKKK (SEQ ID NO: 111), is the prototype of the ubiquitous bipartite signal: two clusters of basic amino acids, separated by a spacer of about 10 amino acids. The sequence of an exemplary bipartite NLS follows:

(SEQ ID NO: 109)
PKKKRKVEGADKRTADGSEFES PKKKRKV.

In some embodiments, the NLS is present in a linker or the NLS is flanked by linkers, for example, the linkers described herein. In some embodiments, the N-terminus or C-terminus NLS is a bipartite NLS. A bipartite NLS comprises two basic amino acid clusters, which are separated by a relatively short spacer sequence (hence bipartite—2 parts, while monopartite NLSs are not). The NLS of nucleoplasmin, KR[PAATKKAGQA]KKKK (SEQ ID NO: 111), is the prototype of the ubiquitous bipartite signal: two clusters of basic amino acids, separated by a spacer of about 10 amino acids. The sequence of an exemplary bipartite NLS is as follows: PKKKRKVEGADKRTADGSEFES PKKKRKV (SEQ ID NO: 109).

The PAM sequence can be any PAM sequence known in the art. Suitable PAM sequences include, but are not limited to, NGG, NGA, NGC, NGN, NGT, NGCG, NGAG, NGAN, NGNG, NGCN, NGCG, NGTN, NNGRRT, NNNRRT, NNGRR(N), TITV, TYCV, TYCV, TATV, NNNNGATT, NNAGAAW, or NAAAAC. Y is a pyrimidine; N is any nucleotide base; W is A or T.

Cas9 Domains with Reduced Exclusivity

Typically, Cas9 proteins, such as Cas9 from *S. pyogenes* (spCas9), require a canonical NGG PAM sequence to bind a particular nucleic acid region, where the "N" in "NGG" is adenosine (A), thymidine (T), or cytosine (C), and the G is guanosine. This may limit the ability to edit desired bases within a genome. In some embodiments, the base editing fusion proteins provided herein may need to be placed at a precise location, for example a region comprising a target base that is upstream of the PAM. See e.g., Komor, A. C., et al., "Programmable editing of a target base in genomic DNA without double-stranded DNA cleavage" *Nature* 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); Nishimasu, H., et al., "Engineered CRISPR-Cas9 nuclease with expanded targeting space"

Science. 2018 Sep. 21; 361(6408):1259-1262, Chatterjee, P., et al., Minimal PAM specificity of a highly similar SpCas9 ortholog" Sci Adv. 2018 Oct. 24; 4(10):eaau0766. doi: 10.1126/sciadv.aau0766; the entire contents of each are hereby incorporated by reference. Several PAM variants are described in the table below:

TABLE 1

Cas9 proteins and corresponding PAM sequences

| Variant | PAM |
| --- | --- |
| spCas9 | NGG |
| spCas9-VRQR | NGA |
| spCas9-VRER | NGCG |
| xCas9 (sp) | NGN |
| saCas9 | NNGRRT |
| saCas9-KKH | NNNRRT |
| spCas9-MQKSER | NGCG |
| spCas9-MQKSER | NGCN |
| spCas9-LRKIQK | NGTN |
| spCas9-LRVSQK | NGTN |
| spCas9-LRVSQL | NGTN |
| SpyMacCas9 | NAA |
| Cpf1 | 5' (TTTV) |

Nucleobase Editing Domain

Described herein are base editors comprising a fusion protein that includes a polynucleotide programmable nucleotide binding domain and a nucleobase (base) editing domain (e.g., deaminase domain). The base editor can be programmed to edit one or more bases in a target polynucleotide sequence by interacting with a guide polynucleotide capable of recognizing the target sequence. Once the target sequence has been recognized, the base editor is anchored on the polynucleotide where editing is to occur and the deaminase domain component of the base editor can then edit a target base.

In some embodiments, the nucleobase editing domain is a deaminase domain. In some cases, a deaminase domain can be a cytosine deaminase or a cytidine deaminase. In some embodiments, the terms "cytosine deaminase" and "cytidine deaminase" can be used interchangeably. In some cases, a deaminase domain can be an adenine deaminase or an adenosine deaminase. In some embodiments, the terms "adenine deaminase" and "adenosine deaminase" can be used interchangeably. Details of nucleobase editing proteins are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

C to T Editing

In some embodiments, a base editor disclosed herein comprises a fusion protein comprising cytidine deaminase capable of deaminating a target cytidine (C) base of a polynucleotide to produce uridine (U), which has the base pairing properties of thymine. In some embodiments, for example where the polynucleotide is double-stranded (e.g. DNA), the uridine base can then be substituted with a thymidine base (e.g. by cellular repair machinery) to give rise to a C:G to a T:A transition. In other embodiments, deamination of a C to U in a nucleic acid by a base editor cannot be accompanied by substitution of the U to a T.

The deamination of a target C in a polynucleotide to give rise to a U is a non-limiting example of a type of base editing that can be executed by a base editor described herein. In another example, a base editor comprising a cytidine deaminase domain can mediate conversion of a cytosine (C) base to a guanine (G) base. For example, a U of a polynucleotide produced by deamination of a cytidine by a cytidine deaminase domain of a base editor can be excised from the polynucleotide by a base excision repair mechanism (e.g., by a uracil DNA glycosylase (UDG) domain), producing an abasic site. The nucleobase opposite the abasic site can then be substituted (e.g. by base repair machinery) with another base, such as a C, by, for example, a translesion polymerase. Although it is typical for a nucleobase opposite an abasic site to be replaced with a C, other substitutions (e.g. A, G or T) can also occur.

Accordingly, in some embodiments a base editor described herein comprises a deamination domain (e.g., cytidine deaminase domain) capable of deaminating a target C to a U in a polynucleotide. Further, as described below, the base editor can comprise additional domains which facilitate conversion of the U resulting from deamination to, in some embodiments, a T or a G. For example, a base editor comprising a cytidine deaminase domain can further comprise a uracil glycosylase inhibitor (UGI) domain to mediate substitution of a U by a T, completing a C-to-T base editing event. In another example, a base editor can incorporate a translesion polymerase to improve the efficiency of C-to-G base editing, since a translesion polymerase can facilitate incorporation of a C opposite an abasic site (i.e., resulting in incorporation of a G at the abasic site, completing the C-to-G base editing event).

A base editor comprising a cytidine deaminase as a domain can deaminate a target C in any polynucleotide, including DNA, RNA and DNA-RNA hybrids. Typically, a cytidine deaminase catalyzes a C nucleobase that is positioned in the context of a single-stranded portion of a polynucleotide. In some embodiments, the entire polynucleotide comprising a target C can be single-stranded. For example, a cytidine deaminase incorporated into the base editor can deaminate a target C in a single-stranded RNA polynucleotide. In other embodiments, a base editor comprising a cytidine deaminase domain can act on a double-stranded polynucleotide, but the target C can be positioned in a portion of the polynucleotide which at the time of the deamination reaction is in a single-stranded state. For example, in embodiments where the NAGPB domain comprises a Cas9 domain, several nucleotides can be left unpaired during formation of the Cas9-gRNA-target DNA complex, resulting in formation of a Cas9 "R-loop complex". These unpaired nucleotides can form a bubble of single-stranded DNA that can serve as a substrate for a single-strand specific nucleotide deaminase enzyme (e.g., cytidine deaminase).

In some embodiments, a cytidine deaminase of a base editor can comprise all or a portion of an apolipoprotein B mRNA editing complex (APOBEC) family deaminase. APOBEC is a family of evolutionarily conserved cytidine deaminases. Members of this family are C-to-U editing enzymes. The N-terminal domain of APOBEC like proteins is the catalytic domain, while the C-terminal domain is a pseudocatalytic domain. More specifically, the catalytic domain is a zinc dependent cytidine deaminase domain and is important for cytidine deamination. APOBEC family members include APOBEC1, APOBEC2, APOBEC3A, APOBEC3B, APOBEC3C, APOBEC3D ("APOBEC3E" now refers to this), APOBEC3F, APOBEC3G, APOBEC3H, APOBEC4, and Activation-induced (cytidine) deaminase. A number of modified cytidine deaminases are commercially available, including but not limited to SaBE3, SaKKH-BE3, VQR-BE3, EQR-BE3, VRER-BE3, YE1-BE3, EE-BE3, YE2-BE3, and YEE-BE3, which are available from Addgene (plasmids 85169, 85170, 85171, 85172, 85173, 85174, 85175, 85176, 85177). In some embodiments, a deaminase incorporated into a base editor comprises all or a portion of an APOBEC1 deaminase. In some embodiments, a deaminase incorporated into a base editor comprises all or a portion of APOBEC2 deaminase. In some embodiments, a deaminase incorporated into a base editor comprises all or a portion of is an APOBEC3 deaminase. In some embodiments, a deaminase incorporated into a base editor comprises all or a portion of an APOBEC3A deaminase. In some embodiments, a deaminase incorporated into a base editor comprises all or a portion of APOBEC3B deaminase. In some embodiments, a deaminase incorporated into a base editor comprises all or a portion of APOBEC3C deaminase. In some embodiments, a deaminase incorporated into a base editor comprises all or a portion of APOBEC3D deaminase. In some embodiments, a deaminase incorporated into a base editor comprises all or a portion of APOBEC3E deaminase. In some embodiments, a deaminase incorporated into a base editor comprises all or a portion of APOBEC3F deaminase. In some embodiments, a deaminase incorporated into a base editor comprises all or a portion of APOBEC3G deaminase. In some embodiments, a deaminase incorporated into a base editor comprises all or a portion of APOBEC3H deaminase. In some embodiments, a deaminase incorporated into a base editor comprises all or a portion of APOBEC4 deaminase. In some embodiments, a deaminase incorporated into a base editor comprises all or a portion of an activation-induced deaminase (AID).

In some embodiments, a deaminase incorporated into a base editor comprises all or a portion of cytidine deaminase 1 (CDA1). It should be appreciated that a base editor can comprise a deaminase from any suitable organism (e.g., a human or a rat). In some embodiments, a deaminase domain of a base editor is from a human, chimpanzee, gorilla, monkey, cow, dog, rat, or mouse. In some embodiments, the deaminase domain of the base editor is derived from rat (e.g., rat APOBEC1). In some embodiments, the deaminase domain of the base editor is human APOBEC1. In some embodiments, the deaminase domain of the base editor is pmCDA1.

The base sequence and amino acid sequence of PmCDA1 and the base sequence and amino acid sequence of CDS of human AID are shown herein below.

```
>tr|A5H718|A5H718_PETMA Cytosine deaminase
OS = Petromyzon marinus OX = 7757 PE = 2 SV = 1:
                                              (SEQ ID NO: 112)
MTDAEYVRIHEKLDIYTFKKQFFNNKKSVSHRCYVLFELKRRGERRACFWG

YAVNKPQSGTERGIHAEIFSIRKVEEYLRDNPGQFTINWYSSWSPCADCAE

KILEWYNQELRGNGHTLKIWACKLYYEKNARNQIGLWNLRDNGVGLNVMVS

EHYQCCRKIFIQSSHNQLNENRWLEKTLKRAEKRRSELSIMIQVKILHTTK

SPAV

Nucleic acid sequence: >EF094822.1 Petromyzon
marinus isolate PmCDA.21 cytosine deaminase mRNA,
complete cds:
                                              (SEQ ID NO: 113)
TGACACGACACAGCCGTGTATATGAGGAAGGGTAGCTGGATGGGGGGGGG

GGAATACGTTCAGAGAGGACATTAGCGAGCGTCTTGTTGGTGGCCTTGAGT

CTAGACACCTGCAGACATGACCGACGCTGAGTACGTGAGAATCCATGAGAA

GTTGGACATCTACACGTTTAAGAAACAGTTTTTCAACAACAAAAAATCCGT

GTCGCATAGATGCTACGTTCTCTTTGAATTAAAACGACGGGGTGAACGTAG

AGCGTGTTTTTGGGGCTATGCTGTGAATAAACCACAGAGCGGGACAGAACG

TGGAATTCACGCCGAAATCTTTAGCATTAGAAAAGTCGAAGAATACCTGCG

CGACAACCCCGGACAATTCACGATAAATTGGTACTCATCCTGGAGTCCTTG

TGCAGATTGCGCTGAAAAGATCTTAGAATGGTATAACCAGGAGCTGCGGGG

GAACGGCCACACTTTGAAAATCTGGGCTTGCAAACTCTATTACGAGAAAAA

TGCGAGGAATCAAATTGGGCTGTGGAACCTCAGAGATAACGGGGTTGGGTT

GAATGTAATGGTAAGTGAACACTACCAATGTTGCAGGAAAATATTCATCCA

ATCGTCGCACAATCAATTGAATGAGAATAGATGGCTTGAGAAGACTTTGAA

GCGAGCTGAAAAACGACGGAGCGAGTTGTCCATTATGATTCAGGTAAAAAT

ACTCCACACCACTAAGAGTCCTGCTGTTTAAGAGGCTATGCGGATGGTTTT

C
```

The amino acid and nucleic acid sequences of the coding sequence (CDS) of human activation-induced cytidine deaminase (AID) are shown below:

```
>tr|Q6QJ80|Q6QJ80_HUMAN Activation-induced cytidine deaminase
OS = Homo sapiens OX = 9606 GN = AICDA PE = 2 SV = 1
                                              (SEQ ID NO: 114)
MDSLLMNRRKFLYQFKNVRWAKGRRETYLCYVVKRRDSATSFSLDFGYLRNKNGCHVELL

FLRYISDWDLDPGRCYRVTWFTSWSPCYDCARHVADFLRGNPNLSLRIFTARLYFCEDRK

AEPEGLRRLHRAGVQIAIMTFKAPV

Nucleic acid sequence: >NG_011588.1:5001-15681 Homo sapiens activation
induced cytidine deaminase (AICDA), RefSeqGene (LRG_17) on chromosome
12:
                                              (SEQ ID NO: 115)
AGAGAACCATCATTAATTGAAGTGAGATTTTTCTGGCCTGAGACTTGCAGGGAGGCAAGAAGACACTCTG

GACACCACTATGGACAGGTAAAGAGGCAGTCTTCTCGTGGGTGATTGCACTGGCCTTCCTCTCAGAGCAA

ATCTGAGTAATGAGACTGGTAGCTATCCCTTTCTCTCATGTAACTGTCTGACTGATAAGATCAGCTTGAT
```

```
-continued
CAATATGCATATATATTTTTTGATCTGTCTCCTTTTCTTCTATTCAGATCTTATACGCTGTCAGCCCAAT

TCTTTCTGTTTCAGACTTCTCTTGATTTCCCTCTTTTTCATGTGGCAAAAGAAGTAGTGCGTACAATGTA

CTGATTCGTCCTGAGATTTGTACCATGGTTGAAACTAATTTATGGTAATAATATTAACATAGCAAATCTT

TAGAGACTCAAATCATGAAAAGGTAATAGCAGTACTGTACTAAAAACGGTAGTGCTAATTTTCGTAATAA

TTTTGTAAATATTCAACAGTAAAACAACTTGAAGACACACTTTCCTAGGGAGGCGTTACTGAAATAATTT

AGCTATAGTAAGAAAATTTGTAATTTTAGAAATGCCAAGCATTCTAAATTAATTGCTTGAAAGTCACTAT

GATTGTGTCCATTATAAGGAGACAAATTCATTCAAGCAAGTTATTTAATGTTAAAGGCCCAATTGTTAGG

CAGTTAATGGCACTTTTACTATTAACTAATCTTTCCATTTGTTCAGACGTAGCTTAACTTACCTCTTAGG

TGTGAATTTGGTTAAGGTCCTCATAATGTCTTTATGTGCAGTTTTTGATAGGTTATTGTCATAGAACTTA

TTCTATTCCTACATTTATGATTACTATGGATGTATGAGAATAACACCTAATCCTTATACTTTACCTCAAT

TTAACTCCTTTATAAAGAACTTACATTACAGAATAAAGATTTTTAAAAATATATTTTTTGTAGAGACA

GGGTCTTAGCCCAGCCGAGGCTGGTCTCTAAGTCCTGGCCCAAGCGATCCTCCTGCCTGGGCCTCCTAAA

GTGCTGGAATTATAGACATGAGCCATCACATCCAATATACAGAATAAAGATTTTTAATGGAGGATTTAAT

GTTCTTCAGAAAATTTTCTTGAGGTCAGACAATGTCAAATGTCTCCTCAGTTTACACTGAGATTTTGAAA

ACAAGTCTGAGCTATAGGTCCTTGTGAAGGGTCCATTGGAAATACTTGTTCAAAGTAAAATGGAAAGCAA

AGGTAAAATCAGCAGTTGAAATTCAGAGAAAGACAGAAAAGGAGAAAAGATGAAATTCAACAGGACAGAA

GGGAAATATATTATCATTAAGGAGGACAGTATCTGTAGAGCTCATTAGTGATGGCAAAATGACTTGGTCA

GGATTATTTTTAACCCGCTTGTTTCTGGTTTGCACGGCTGGGGATGCAGCTAGGGTTCTGCCTCAGGGAG

CACAGCTGTCCAGAGCAGCTGTCAGCCTGCAAGCCTGAAACACTCCCTCGGTAAAGTCCTTCCTACTCAG

GACAGAAATGACGAGAACAGGGAGCTGGAAACAGGCCCCTAACCAGAGAAGGGAAGTAATGGATCAACAA

AGTTAACTAGCAGGTCAGGATCACGCAATTCATTTCACTCTGACTGGTAACATGTGACAGAAACAGTGTA

GGCTTATTGTATTTTCATGTAGAGTAGGACCCAAAAATCCACCCAAAGTCCTTTATCTATGCCACATCCT

TCTTATCTATACTTCCAGGACACTTTTTCTTCCTTATGATAAGGCTCTCTCTCTCCACACACACAC

ACACACACACACACACACACACACACACAAACACACACCCCGCCAACCAAGGTGCATGTAAAAAGA

TGTAGATTCCTCTGCCTTTCTCATCTACACAGCCCAGGAGGGTAAGTTAATATAAGAGGGATTTATTGGT

AAGAGATGATGCTTAATCTGTTTAACACTGGGCCTCAAAGAGAGAATTTCTTTTCTTCTGTACTTATTAA

GCACCTATTATGTGTTGAGCTTATATATACAAAGGGTTATTATATGCTAATATAGTAATAGTAATGGTGG

TTGGTACTATGGTAATTACCATAAAAATTATTATCCTTTTAAAATAAAGCTAATTATTATTGGATCTTTT

TTAGTATTCATTTTATGTTTTTTATGTTTTTGATTTTTTAAAAGACAATCTCACCCTGTTACCCAGGCTG

GAGTGCAGTGGTGCAATCATAGCTTTCTGCAGTCTTGAACTCCTGGGCTCAAGCAATCCTCCTGCCTTGG

CCTCCCAAAGTGTTGGGATACAGTCATGAGCCACTGCATCTGGCCTAGGATCCATTTAGATTAAAATATG

CATTTTAAATTTTAAAATAATATGGCTAATTTTTACCTTATGTAATGTGTATACTGGCAATAAATCTAGT

TTGCTGCCTAAAGTTTAAAGTGCTTTCCAGTAAGCTTCATGTACGTGAGGGGAGACATTTAAAGTGAAAC

AGACAGCCAGGTGTGGTGGCTCACGCCTGTAATCCCAGCACTCTGGGAGGCTGAGGTGGGTGGATCGCTT

GAGCCCTGGAGTTCAAGACCAGCCTGAGCAACATGGCAAAACGCTGTTTCTATAACAAAAATTAGCCGGG

CATGGTGGCATGTGCCTGTGGTCCCAGCTACTAGGGGGCTGAGGCAGGAGAATCGTTGGAGCCCAGGAGG

TCAAGGCTGCACTGAGCAGTGCTTGCGCCACTGCACTCCAGCCTGGGTGACAGGACCAGACCTTGCCTCA

AAAAAATAAGAAGAAAAATTAAAAATAAATGGAAACAACTACAAAGAGCTGTTGTCCTAGATGAGCTACT

TAGTTAGGCTGATATTTTGGTATTTAACTTTTAAAGTCAGGGTCTGTCACCTGCACTACATTATTAAAAT

ATCAATTCTCAATGTATATCCACACAAAGACTGGTACGTGAATGTTCATAGTACCTTTATTCACAAAACC
```

-continued

```
CCAAAGTAGAGACTATCCAAATATCCATCAACAAGTGAACAAATAAACAAAATGTGCTATATCCATGCAA

TGGAATACCACCCTGCAGTACAAAGAAGCTACTTGGGGATGAATCCCAAAGTCATGACGCTAAATGAAAG

AGTCAGACATGAAGGAGGAGATAATGTATGCCATACGAAATTCTAGAAAATGAAAGTAACTTATAGTTAC

AGAAAGCAAATCAGGGCAGGCATAGAGGCTCACACCTGTAATCCCAGCACTTTGAGAGGCCACGTGGGAA

GATTGCTAGAACTCAGGAGTTCAAGACCAGCCTGGGCAACACAGTGAAACTCCATTCTCCACAAAAATGG

GAAAAAAGAAAGCAAATCAGTGGTTGTCCTGTGGGAGGGGAAGGACTGCAAAGAGGGAAGAAGCTCTG

GTGGGGTGAGGGTGGTGATTCAGGTTCTGTATCCTGACTGTGGTAGCAGTTTGGGGTGTTTACATCCAAA

AATATTCGTAGAATTATGCATCTTAAATGGGTGGAGTTTACTGTATGTAAATTATACCTCAATGTAAGAA

AAAATAATGTGTAAGAAAACTTTCAATTCTCTTGCCAGCAAACGTTATTCAAATTCCTGAGCCCTTTACT

TCGCAAATTCTCTGCACTTCTGCCCCGTACCATTAGGTGACAGCACTAGCTCCACAAATTGGATAAATGC

ATTTCTGGAAAAGACTAGGGACAAAATCCAGGCATCACTTGTGCTTTCATATCAACCATGCTGTACAGCT

TGTGTTGCTGTCTGCAGCTGCAATGGGGACTCTTGATTTCTTTAAGGAAACTTGGGTTACCAGAGTATTT

CCACAAATGCTATTCAAATTAGTGCTTATGATATGCAAGACACTGTGCTAGGAGCCAGAAAACAAAGAGG

AGGAGAAATCAGTCATTATGTGGGAACAACATAGCAAGATATTTAGATCATTTTGACTAGTTAAAAAAGC

AGCAGAGTACAAAATCACACATGCAATCAGTATAATCCAAATCATGTAAATATGTGCCTGTAGAAAGACT

AGAGGAATAAACACAAGAATCTTAACAGTCATTGTCATTAGACACTAAGTCTAATTATTATTATTAGACA

CTATGATATTTGAGATTTAAAAAATCTTTAATATTTTAAAATTTAGAGCTCTTCTATTTTTCCATAGTAT

TCAAGTTTGACAATGATCAAGTATTACTCTTTCTTTTTTTTTTTTTTTTTTTTTGAGATGGAGTTT

TGGTCTTGTTGCCCATGCTGGAGTGGAATGGCATGACCATAGCTCACTGCAACCTCCACCTCCTGGGTTC

AAGCAAAGCTGTCGCCTCAGCCTCCCGGGTAGATGGGATTACAGGCGCCCACCACCACACTCGGCTAATG

TTTGTATTTTAGTAGAGATGGGGTTTCACCATGTTGGCCAGGCTGGTCTCAAACTCCTGACCTCAGAGG

ATCCACCTGCCTCAGCCTCCCAAAGTGCTGGGATTACAGATGTAGGCCACTGCGCCCGGCCAAGTATTGC

TCTTATACATTAAAAAACAGGTGTGAGCCACTGCGCCCAGCCAGGTATTGCTCTTATACATTAAAAAATA

GGCCGGTGCAGTGGCTCACGCCTGTAATCCCAGCACTTTGGGAAGCCAAGGCGGGCAGAACACCCGAGGT

CAGGAGTCCAAGGCCAGCCTGGCCAAGATGGTGAAACCCCGTCTCTATTAAAAATACAAACATTACCTGG

GCATGATGGTGGGCGCCTGTAATCCCAGCTACTCAGGAGGCTGAGGCAGGAGGATCCGCGGAGCCTGGCA

GATCTGCCTGAGCCTGGGAGGTTGAGGCTACAGTAAGCCAAGATCATGCCAGTATACTTCAGCCTGGGCG

ACAAAGTGAGACCGTAACAAAAAAAAAAAAATTTAAAAAAAGAAATTTAGATCAAGATCCAACTGTAAAA

AGTGGCCTAAACACCACATTAAAGAGTTTGGAGTTTATTCTGCAGGCAGAAGAGAACCATCAGGGGGTCT

TCAGCATGGGAATGGCATGGTGCACCTGGTTTTTGTGAGATCATGGTGGTGACAGTGTGGGGAATGTTAT

TTTGGAGGGACTGGAGGCAGACAGACCGGTTAAAAGGCCAGCACAACAGATAAGGAGGAAGAAGATGAGG

GCTTGGACCGAAGCAGAGAAGAGCAAACAGGGAAGGTACAAATTCAAGAAATATTGGGGGGTTTGAATCA

ACACATTTAGATGATTAATTAAATATGAGGACTGAGGAATAAGAAATGAGTCAAGGATGGTTCCAGGCTG

CTAGGCTGCTTACCTGAGGTGGCAAAGTCGGGAGGAGTGGCAGTTTAGGACAGGGGGCAGTTGAGGAATA

TTGTTTTGATCATTTTGAGTTTGAGGTACAAGTTGGACACTTAGGTAAAGACTGGAGGGGAAATCTGAAT

ATACAATTATGGGACTGAGGAACAAGTTTATTTTATTTTTTGTTTCGTTTTCTTGTTGAAGAACAAATTT

AATTGTAATCCCAAGTCATCAGCATCTAGAAGACAGTGGCAGGAGGTGACTGTCTTGTGGGTAAGGGTTT

GGGGTCCTTGATGAGTATCTCTCAATTGGCCTTAAATATAAGCAGGAAAAGGAGTTTATGATGGATTCCA

GGCTCAGCAGGGCTCAGGAGGGCTCAGGCAGCCAGCAGAGGAAGTCAGAGCATCTTCTTTGGTTTAGCCC

AAGTAATGACTTCCTTAAAAAGCTGAAGGAAAATCCAGAGTGACCAGATTATAAACTGTACTCTTGCATT

TTCTCTCCCTCCTCTCACCCACAGCCTCTTGATGAACCGGAGGAAGTTTCTTTACCAATTCAAAAATGTC
```

-continued

```
CGCTGGGCTAAGGGTCGGCGTGAGACCTACCTGTGCTACGTAGTGAAGAGGCGTGACAGTGCTACATCCT
TTTCACTGGACTTTGGTTATCTTCGCAATAAGGTATCAATTAAAGTCGGCTTTGCAAGCAGTTTAATGGT
CAACTGTGAGTGCTTTTAGAGCCACCTGCTGATGGTATTACTTCCATCCTTTTTTGGCATTTGTGTCTCT
ATCACATTCCTCAAATCCTTTTTTTATTTCTTTTTCCATGTCCATGCACCCATATTAGACATGGCCCAA
AATATGTGATTTAATTCCTCCCCAGTAATGCTGGGCACCCTAATACCACTCCTTCCTTCAGTGCCAAGAA
CAACTGCTCCCAAACTGTTTACCAGCTTTCCTCAGCATCTGAATTGCCTTTGAGATTAATTAAGCTAAAA
GCATTTTTATATGGGAGAATATTATCAGCTTGTCCAAGCAAAAATTTTAAATGTGAAAAACAAATTGTGT
CTTAAGCATTTTTGAAAATTAAGGAAGAAGAATTTGGGAAAAAATTAACGGTGGCTCAATTCTGTCTTCC
AAATGATTTCTTTTCCCTCCTACTCACATGGGTCGTAGGCCAGTGAATACATTCAACATGGTGATCCCCA
GAAAACTCAGAGAAGCCTCGGCTGATGATTAATTAAATTGATCTTTCGGCTACCCGAGAGAATTACATTT
CCAAGAGACTTCTTCACCAAAATCCAGATGGGTTTACATAAACTTCTGCCCACGGGTATCTCCTCTCTCC
TAACACGCTGTGACGTCTGGGCTTGGTGGAATCTCAGGGAAGCATCCGTGGGGTGGAAGGTCATCGTCTG
GCTCGTTGTTTGATGGTTATATTACCATGCAATTTTCTTTGCCTACATTTGTATTGAATACATCCCAATC
TCCTTCCTATTCGGTGACATGACACATTCTATTTCAGAAGGCTTTGATTTTATCAAGCACTTTCATTTAC
TTCTCATGGCAGTGCCTATTACTTCTCTTACAATACCCATCTGTCTGCTTTACCAAAATCTATTTCCCCT
TTTCAGATCCTCCCAAATGGTCCTCATAAACTGTCCTGCCTCCACCTAGTGGTCCAGGTATATTTCCACA
ATGTTACATCAACAGGCACTTCTAGCCATTTTCCTTCTCAAAAGGTGCAAAAAGCAACTTCATAAACACA
AATTAAATCTTCGGTGAGGTAGTGTGATGCTGCTTCCTCCCAACTCAGCGCACTTCGTCTTCCTCATTCC
ACAAAAACCCATAGCCTTCCTTCACTCTGCAGGACTAGTGCTGCCAAGGGTTCAGCTCTACCTACTGGTG
TGCTCTTTTGAGCAAGTTGCTTAGCCTCTCTGTAACACAAGGACAATAGCTGCAAGCATCCCCAAAGATC
ATTGCAGGAGACAATGACTAAGGCTACCAGAGCCGCAATAAAAGTCAGTGAATTTTAGCGTGGTCCTCTC
TGTCTCTCCAGAACGGCTGCCACGTGGAATTGCTCTTCCTCCGCTACATCTCGGACTGGGACCTAGACCC
TGGCCGCTGCTACCGCGTCACCTGGTTCACCTCCTGGAGCCCCTGCTACGACTGTGCCCGACATGTGGCC
GACTTTCTGCGAGGGAACCCCAACCTCAGTCTGAGGATCTTCACCGCGCGCCTCTACTTCTGTGAGGACC
GCAAGGCTGAGCCCGAGGGGCTGCGGCGGCTGCACCGCGCCGGGGTGCAAATAGCCATCATGACCTTCAA
AGGTGCGAAAGGGCCTTCCGCGCAGGCGCAGTGCAGCAGCCCGCATTCGGGATTGCGATGCGGAATGAAT
GAGTTAGTGGGGAAGCTCGAGGGGAAGAAGTGGGCGGGGATTCTGGTTCACCTCTGGAGCCGAAATTAAA
GATTAGAAGCAGAGAAAAGAGTGAATGGCTCAGAGACAAGGCCCCGAGGAAATGAGAAAATGGGGCCAGG
GTTGCTTCTTTCCCCTCGATTTGGAACCTGAACTGTCTTCTACCCCCATATCCCCGCCTTTTTTCCTTT
TTTTTTTTTTGAAGATTATTTTTACTGCTGGAATACTTTTGTAGAAAACCACGAAAGAACTTTCAAAGCC
TGGGAAGGGCTGCATGAAAATTCAGTTCGTCTCTCCAGACAGCTTCGGCGCATCCTTTTGGTAAGGGGCT
TCCTCGCTTTTTAAATTTTCTTTCTTTCTCTACAGTCTTTTTTGGAGTTTCGTATATTTCTTATATTTTC
TTATTGTTCAATCACTCTCAGTTTTCATCTGATGAAAACTTTATTTCTCCTCCACATCAGCTTTTTCTTC
TGCTGTTTCACCATTCAGAGCCCTCTGCTAAGGTTCCTTTTCCCTCCCTTTTCTTTCTTTTGTTGTTTCA
CATCTTTAAATTTCTGTCTCTCCCCAGGGTTGCGTTTCCTTCCTGGTCAGAATTCTTTTCTCCTTTTTTT
TTTTTTTTTTTTTTTTTAAACAAACAAACAAAAAACCCAAAAAAACTCTTTCCCAATTTACTTTCTT
CCAACATGTTACAAAGCCATCCACTCAGTTTAGAAGACTCTCCGGCCCCACCGACCCCCAACCTCGTTTT
GAAGCCATTCACTCAATTTGCTTCTCTCTTTCTCTACAGCCCCTGTATGAGGTTGATGACTTACGAGACG
CATTTCGTACTTTGGGACTTTGATAGCAACTTCCAGGAATGTCACACACGATGAAATATCTCTGCTGAAG
ACAGTGGATAAAAAACAGTCCTTCAAGTCTTCTCTGTTTTTATTCTTCAACTCTCACTTTCTTAGAGTTT
```

-continued

ACAGAAAAAATATTTATATACGACTCTTTAAAAAGATCTATGTCTTGAAAATAGAGAAGGAACACAGGTC

TGGCCAGGGACGTGCTGCAATTGGTGCAGTTTTGAATGCAACATTGTCCCCTACTGGGAATAACAGAACT

GCAGGACCTGGGAGCATCCTAAAGTGTCAACGTTTTCTATGACTTTTAGGTAGGATGAGAGCAGAAGGT

AGATCCTAAAAAGCATGGTGAGAGGATCAAATGTTTTTATATCAACATCCTTTATTATTTGATTCATTTG

AGTTAACAGTGGTGTTAGTGATAGATTTTTCTATTCTTTTCCCTTGACGTTTACTTTCAAGTAACACAAA

CTCTTCCATCAGGCCATGATCTATAGGACCTCCTAATGAGAGTATCTGGGTGATTGTGACCCCAAACCAT

CTCTCCAAAGCATTAATATCCAATCATGCGCTGTATGTTTTAATCAGCAGAAGCATGTTTTTATGTTTGT

ACAAAAGAAGATTGTTATGGGTGGGGATGGAGGTATAGACCATGCATGGTCACCTTCAAGCTACTTTAAT

AAAGGATCTTAAAATGGGCAGGAGGACTGTGAACAAGACACCCTAATAATGGGTTGATGTCTGAAGTAGC

AAATCTTCTGGAAACGCAAACTCTTTTAAGGAAGTCCCTAATTTAGAAACACCCACAAACTTCACATATC

ATAATTAGCAAACAATTGGAAGGAAGTTGCTTGAATGTTGGGGAGAGGAAAATCTATTGGCTCTCGTGGG

TCTCTTCATCTCAGAAATGCCAATCAGGTCAAGGTTTGCTACATTTTGTATGTGTGTGATGCTTCTCCCA

AAGGTATATTAACTATATAAGAGAGTTGTGACAAAACAGAATGATAAAGCTGCGAACCGTGGCACACGCT

CATAGTTCTAGCTGCTTGGGAGGTTGAGGAGGGAGGATGGCTTGAACACAGGTGTTCAAGGCCAGCCTGG

GCAACATAACAAGATCCTGTCTCTCAAAAAAAAAAAAAAAAAAAAGAAAGAGAGAGGGCCGGGCGTGGTG

GCTCACGCCTGTAATCCCAGCACTTTGGGAGGCCGAGCCGGGCGGATCACCTGTGGTCAGGAGTTTGAGA

CCAGCCTGGCCAACATGGCAAAACCCCGTCTGTACTCAAAATGCAAAAATTAGCCAGGCGTGGTAGCAGG

CACCTGTAATCCCAGCTACTTGGGAGGCTGAGGCAGGAGAATCGCTTGAACCCAGGAGGTGGAGGTTGCA

GTAAGCTGAGATCGTGCCGTTGCACTCCAGCCTGGGCGACAAGAGCAAGACTCTGTCTCAGAAAAAAAAA

AAAAAAGAGAGAGAGAGAAAGAGAACAATATTTGGGAGAGAAGGATGGGGAAGCATTGCAAGGAAAT

TGTGCTTTATCCAACAAAATGTAAGGAGCCAATAAGGGATCCCTATTTGTCTCTTTTGGTGTCTATTTGT

CCCTAACAACTGTCTTTGACAGTGAGAAAAATATTCAGAATAACCATATCCCTGTGCCGTTATTACCTAG

CAACCCTTGCAATGAAGATGAGCAGATCCACAGGAAAACTTGAATGCACAACTGTCTTATTTTAATCTTA

TTGTACATAAGTTTGTAAAAGAGTTAAAAATTGTTACTTCATGTATTCATTTATATTTTATATTATTTTG

CGTCTAATGATTTTTTATTAACATGATTTCCTTTTCTGATATATTGAAATGGAGTCTCAAAGCTTCATAA

ATTTATAACTTTAGAAATGATTCTAATAACAACGTATGTAATTGTAACATTGCAGTAATGGTGCTACGAA

GCCATTTCTCTTGATTTTTAGTAAACTTTTATGACAGCAAATTTGCTTCTGGCTCACTTTCAATCAGTTA

AATAAATGATAAATAATTTTGGAAGCTGTGAAGATAAAATACCAAATAAAATAATATAAAAGTGATTTAT

ATGAAGTTAAAATAAAAAATCAGTATGATGGAATAAACTTG

Other exemplary deaminases that can be fused to Cas9 according to aspects of this disclosure are provided below. It should be understood that, in some embodiments, the active domain of the respective sequence can be used, e.g., the domain without a localizing signal (nuclear localization sequence, without nuclear export signal, cytoplasmic localizing signal).

Human AID:
(SEQ ID NO: 116)
<u>MDSLLMNRRKFLYQFKNVRWAKGRRETYLC</u>YVVKRRDSATSFSLDFGYLRNKNGCH

VELLFLRYISDWDLDPGRCYRVTWFTSWSPCYDCARHVADFLRGNPNLSLRIFTARLYF

CEDRKAEPEGLRRLHRAGVQIAIMTEKDYFYCWNTFVENHERTFKAWEGLHENSVRLS

RQLRRILLP<u><u>LYEVDDLRDAFRTLGL</u></u>
(underline: nuclear localization sequence; double underline: nuclear export signal)

-continued

Mouse AID:
(SEQ ID NO: 117)
<u>MDSLLMKQKKFLYHFKNVRWAKGRHETYLC</u>YVVKRRDSATSCSLDFGHLRNKSGCH

VELLFLRYISDWDLDPGRCYRVTWFTSWSPCYDCARHVAEFLRWNPNLSLRIFTARLYF

CEDRKAEPEGLRRLHRAGVQIGIMTEKDYFYCWNTFVENRERTFKAWEGLHENSVRLT

RQLRRILL<u>PLYEVDDLRDAFRMLGF</u>
(underline: nuclear localization sequence; double underline: nuclear export signal)

Canine AID:
(SEQ ID NO: 118)
<u>MDSLLMKQRKFLYHFKNVRWAKGRHETYLC</u>YVVKRRDSATSFSLDFGHLRNKSGCHV

ELLFLRYISDWDLDPGRCYRVTWFTSWSPCYDCARHVADFLRGYPNLSLRIFAARLYFC

EDRKAEPEGLRRLHRAGVQIAIMTFKDYFYCWNTFVENREKTFKAWEGLHENSVRLSR

QLRRILL<u>PLYEVDDLRDAFRTLGL</u>
(underline: nuclear localization sequence; double underline: nuclear export signal)

Bovine AID:
(SEQ ID NO: 119)
<u>MDSLLKKQRQFLYQFKNVRWAKGRHETYLC</u>YVVKRRDSPTSFSLDFGHLRNKAGCHV

ELLFLRYISDWDLDPGRCYRVTWFTSWSPCYDCARHVADFLRGYPNLSLRIFTARLYFC

DKERKAEPEGLRRLHRAGVQIAIMTFKDYFYCWNTFVENHERTFKAWEGLHENSVRLS

RQLRRILL<u>PLYEVDDLRDAFRTLGL</u>
(underline: nuclear localization sequence; double underline: nuclear export signal)

Rat AID
(SEQ ID NO: 120)
<u>MAVGSKPKAALVGPHWERERIWCFLC</u>STGLGTQQTGQTSRWLRPAATQDPVSPPRSLL

MKQRKFLYHFKNVRWAKGRHETYLCYVVKRRDSATSFSLDFGYLRNKSGCHVELLFL

RYISDWDLDPGRCYRVTWFTSWSPCYDCARHVADFLRGNPNLSLRIFTARLTGWGALP

AGLMSPARPSDYFYCWNTFV<u>ENHERTFKAWEGLHENSVRLSRRLRRILLPLYEVDDLR

DAFRTLGL</u>
(underline: nuclear localization sequence; double underline: nuclear export signal)

Mouse APOBEC-3
(SEQ ID NO: 121)
MGPFCLGCSHRKCYSPIRNLISQETFKFHFKNLGYAKGRKDTFLCYEVTRKDCDSPVSL

HHGVFKNKDNI*HAEICFLYWFHDKVLKVLSPREEFKITWYMSWSPCFEC*AEQIVRFLATHH

NLSLDIFSSRLYNVQDPETQQNLCRLVQEGAQVAAMDLYEFKKCWKKFVDNGGRRFR

PWKRLLTNFRYQDSKLQEILRPCYIPVPSSSSSTLSNICLTKGLPETRFCVEGRRMDPLSE

EEFYSQFYNQRVKHLCYYHRMKPYLCYQLEQFNGQAPLKGCLLSEKGKQ*HAEILFLDKI

RSMELSQVTITCYLTWSPCPNC*AWQLAAFKRDRPDLILHIYTSRLYFHWKRPFQKGLCSL

WQSGILVDVMDLPQFTDCWTNFVNPKRPFWPWKGLEIISRRTQRRLRRIKESWGLQDL

VNDFGNLQLGPPMS
(italic: nucleic acid editing domain)

Rat APOBEC-3:
(SEQ ID NO: 122)
MGPFCLGCSHRKCYSPIRNLISQETFKFHFKNRLRYAIDRKDTFLCYEVTRKDCDSPVSL

HHGVFKNKDNI*HAEICFLYWFHDKVLKVLSPREEFKITWYMSWSPCFEC*AEQVRFLATH

HNLSLDIFSSRLYNIRDPENQQNLCRLVQEGAQVAAMDLYEFKKCWKKFVDNGGRRFR

PWKKLLTNFRYQDSKLQEILRPCYIPVPSSSSSTLSNICLTKGLPETRFCVERRRVHLLSE

EEFYSQFYNQRVKHLCYYHGVKPYLCYQLEQFNGQAPLKGCLLSEKGKQ*HAEILFLDKI

*RSMELSQVIITCYLTWSPCPNC*AWQLAAFKRDRPDLILHIYTSRLYFHWKRPFQKGLCSL

WQSGILVDVMDLPQFTDCWTNFVNPKRPFWPWKGLEIISRRTQRRLHRIKESWGLQDL

VNDFGNLQLGPPMS
(italic: nucleic acid editing domain)

Rhesus macaque APOBEC-3G:
(SEQ ID NO: 123)
MVEPMDPRTFVSNFNNRPILSGLNTVWLCCEVKTKDPSGPPLDAKIFQGKVYSKAKY<u>H</u>

<u>PEMRFLRWFHKWRQLHHDQEYKVTWYVSWSPCTRC</u>ANSVATFLAKDPKVTLTIFVARLY

YFWKPDYQQALRILCQKRGGPHATMKIMNYNEFQDCWNKFVDGRGKPFKPRNNLPKH

YTLLQATLGELLRHLMDPGTFTSNFNNKPWVSGQHETYLCYKVERLHNDTWVPLNQH

RGFLRNQAPNIFIGFPKGR*HAELCFLDLIPFWKLDGQQYRVTCFTSWSPCFSC*AQEMAKFIS

NNEHVSLCIFAARIYDDQGRYQEGLRALHRDGAKIAMMNYSEFEYCWDTFVDRQGRPF

QPWDGLDEHSQALSGRLRAI
(italic: nucleic acid editing domain; underline: cytoplasmic localization signal)

Chimpanzee APOBEC-3G:
(SEQ ID NO: 124)
<u>MKPHFRNPVERMYQDTFSDNFYNRPILSHRNTVWLCYEVKTKGPSRPPLDAKIFRGQV</u>

<u>YSKLKY</u>*HPEMRFFHWFSKWRKLHRDQEYEVTWYISWSPCTKC*TRDVATFLAEDPKVTLTI

FVARLYYFWDPDYQEALRSLCQKRDGPRATMKIMNYDEFQHCWSKFVYSQRELFEPW

NNLPKYYILLHIMLGEILRHSMDPPTFTSNFNNELWVRGRHETYLCYEVERLHNDTWVL

LNQRRGFLCNQAPHKHGFLEGR*HAELCFLDVIPFWKLDLHQDYRVTCFTSWSPCFSC*AQE

MAKFISNNKHVSLCIFAARIYDDQGRCQEGLRTLAKAGAKISIMTYSEFKHCWDTFVDH

QGCPFQPWDGLEEHSQALSGRLRAILQNQGN
(italic: nucleic acid editing domain; underline: cytoplasmic localization signal)

Green monkey APOBEC-3G:
(SEQ ID NO: 125)
<u>MNPQIRNMVEQMEPDIFVYYFNNRPILSGRNTVWLCYEVKTKDPSGPPLDANIFQGKLY</u>

<u>PEAKD</u>*HPEMKFLHWFRKWRQLHRDQEYEVTWYVSWSPCTRC*ANSVATFLAEDPKVTLTIF

VARLYYFWKPDYQQALRILCQERGGPHATMKIMNYNEFQHCWNEFVDGQGKPFKPRK

NLPKHYTLLHATLGELLRHVMDPGTFTSNFNNKPWVSGQRETYLCYKVERSHNDTWV

LLNQHRGFLRNQAPDRHGFPKGR*HAELCFLDLIPFWKLDDQQYRVTCFTSWSPCFSC*AQK

MAKFISNNKHVSLCIFAARIYDDQGRCQEGLRTLHRDGAKIAVMNYSEFEYCWDTFVD

RQGRPFQPWDGLDEHSQALSGRLRAI
(italic: nucleic acid editing domain; underline: cytoplasmic localization signal)

Human APOBEC-3G:
(SEQ ID NO: 126)
<u>MKPHFRNTVERMYRDTFSYNFYNRPILSRRNTVWLCYEVKTKGPSRPPLDAKIFRGQV</u>

<u>YSELKY</u>*HPEMRFFHWFSKWRKLHRDQEYEVTWYISWSPCTKC*TRDMATFLAEDPKVTLTI

FVARLYYFWDPDYQEALRSLCQKRDGPRATMKIMNYDEFQHCWSKFVYSQRELFEPW

NNLPKYYILLHIMLGEILRHSMDPPTFTFNFNNEPWVRGRHETYLCYEVERMHNDTWV

LLNQRRGFLCNQAPHKHGFLEGR*HAELCFLDVIPFWKLDLDQDYRVTCFTSWSPCFSC*AQ

EMAKFISKNKHVSLCIFTARIYDDQGRCQEGLRTLAEAGAKISIMTYSEFKHCWDTFVD

HQGCPFQPWDGLDEHSQDLSGRLRAILQNQEN
(italic: nucleic acid editing domain; underline: cytoplasmic localization signal)

-continued

Human APOBEC-3F:

(SEQ ID NO: 127)

MKPHFRNTVERMYRDTFSYNFYNRPILSRRNTVWLCYEVKTKGPSRPRLDAKIFRGQV

YSQPEH*HAEMCFLSWFCGNQLPAYKCFQITWFVSWTPCPDC*VAKLAEFLAEHPNVTLTIS

AARLYYYWERDYRRALCRLSQAGARVKIMDDEEFAYCWENFVYSEGQPFMPWYKFD

DNYAFLHRTLKEILRNPMEAMYPHIFYFHFKNLRKAYGRNESWLCFTMEVVKHESPVS

WKRGVFRNQVDPETH*CHAERCFLSWFCDDILSPNTNYEVTWYTSWSPCPEC*AGEVAEF

LARHSNVNLTIFTARLYYFWDTDYQEGLRSLSQEGASVEIMGYKDFKYCWENFVYND

DEPFKPWKGLKYNFLFLDSKLQEILE
(italic: nucleic acid editing domain)

Human APOBEC-3B:

(SEQ ID NO: 128)

MNPQIRNPMERMYRDTFYDNFENEPILYGRSYTWLCYEVKIKRGRSNLLWDTGVFRGQ

VYFKPQY*HAEMCFLSWFCGNQLPAYKCFQITWFVSWTPCPDC*VAKLAEFLSEHPNVTLTI

SAARLYYYWERDYRRALCRLSQAGARVTIMDYEEFAYCWENFVYNEGQQFMPWYKF

DENYAFLHRTLKEILRYLMDPDTFTFNFNNDPLVLRRRQTYLCYEVERLDNGTWVLMD

QHMGFLCNEAKNLLCGFY*GRHAELRFLDLVPSLQLDPAQIYRVTWFISWSPCFSWGC*AGE

VRAFLQENTHVRLRIFAARIYDYDPLYKEALQMLRDAGAQVSIMTYDEFEYCWDTFVY

RQGCPFQPWDGLEEHSQALSGRLRAILQNQGN
(italic: nucleic acid editing domain)

Rat APOBEC-3B:

(SEQ ID NO: 129)

MQPQGLGPNAGMGPVCLGCSHRRPYSPIRNPLKKLYQQTFYFHFKNVRYAWGRKNNF

LCYEVNGMDCALPVPLRQGVFRKQGHIHAELCFIYWFHDKVLRVLSPMEEFKVTWYM

SWSPCSKCAEQVARFLAAHRNLSLAIFSSRLYYYLRNPNYQQKLCRLIQEGVHVAAMD

LPEFKKCWNKFVDNDGQPFRPWMRLRINFSFYDCKLQEIFSRMNLLREDVFYLQFNNS

HRVKPVQNRYYRRKSYLCYQLERANGQEPLKGYLLYKKGEQHVEILFLEKMRSMELS

QVRITCYLTWSPCPNCARQLAAFKKDHPDLILRIYTSRLYFWRKKFQKGLCTLWRSGIH

VDVMDLPQFADCWTNFVNPQRPFRPWNELEKNSWRIQRRLRRIKESWGL

Bovine APOBEC-3B:

(SEQ ID NO: 130)

DGWEVAFRSGTVLKAGVLGVSMTEGWAGSGHPGQGACVWTPGTRNTMNLLREVLFK

QQFGNQPRVPAPYYRRKTYLCYQLKQRNDLTLDRGCFRNKKQRHAERFIDKINSLDLN

PSQSYKIICYITWSPCPNCANELVNFITRNNHLKLEIFASRLYFHWIKSFKMGLQDLQNA

GISVAVMTHTEFEDCWEQFVDNQSRPFQPWDKLEQYSASIRRRLQRILTAPI

Chimpanzee APOBEC-3B:

(SEQ ID NO: 131)

MNPQIRNPMEWMYQRTFYYNFENEPILYGRSYTWLCYEVKIRRGHSNLLWDTGVFRG

QMYSQPEHHAEMCFLSWFCGNQLSAYKCFQITWFVSWTPCPDCVAKLAKFLAEHPNV

TLTISAARLYYYWERDYRRALCRLSQAGARVKIMDDEEFAYCWENFVYNEGQPFMPW

YKFDDNYAFLHRTLKEIIRHLMDPDTFTFNFNNDPLVLRRHQTYLCYEVERLDNGTWV

LMDQHMGFLCNEAKNLLCGFYGRHAELRFLDLVPSLQLDPAQIYRVTWFISWSPCFSW

GCAGQVRAFLQENTHVRLRIFAARIYDYDPLYKEALQMLRDAGAQVSIMTYDEFEYC

WDTFVYRQGCPFQPWDGLEEHSQALSGRLRAILQVRASSLCMVPHRPPPPPQSPGPCLP

LCSEPPLGSLLPTGRPAPSLPFLLTASFSFPPPASLPPLPSLSLSPGHLPVPSFHSLTSCSIQP

PCSSRIRETEGWASVSKEGRDLG

-continued

Human APOBEC-3C:
(SEQ ID NO: 132)
MNPQIRNPMKAMYPGTFYFQFKNLWEANDRNETWLCFTVEGIKRRSVVSWKTGVFRN

QVDSETH*CHAERCFLSWFCDDILSPNTKYQVTWYTSWSPCPDC*AGEVAEFLARHSNVNLT

IFTARLYYFQYPCYQEGLRSLSQEGVAVEIMDYEDFKYCWENFVYNDNEPFKPWKGLK

TNFRLLKRRLRESLQ
(italic: nucleic acid editing domain)

Gorilla APOBEC-3C
(SEQ ID NO: 133)
MNPQIRNPMKAMYPGTFYFQFKNLWEANDRNETWLCFTVEGIKRRSVVSWKTGVFRN

QVDSETH*CHAERCFLSWECDDILSPNTIVYQVTWYTSWSPCPEC*AGEVAEFLARHSNVNLTI

FTARLYYFQDTDYQEGLRSLSQEGVAVKIMDYKDFKYCWENFVYNDDEPFKPWKGLK

YNFRFLKRRLQEILE

Human APOBEC-3A:
(SEQ ID NO: 134)
MEASPASGPRHLMDPHIFTSNFNNGIGREIKTYLCYEVERLDNGTSVKMDQHRGFLHNQ

AKNLLCGFYGR*HAELRFLDLVPSLQLDPAQIYRVTWFISWSPCFSWGC*AGEVRAFLQENT

HVRLRIFAARIYDYDPLYKEALQMLRDAGAQVSIMTYDEFKHCWDTFVDHQGCPFQP

WDGLDEHSQALSGRLRAILQNGN
(italic: nucleic acid editing domain)

Rhesus macaque APOBEC-3A:
(SEQ ID NO: 135)
MDGSPASRPRHLMDPNTFTFNFNNDLSVRGRHQTYLCYEVERLDNGTWVPMDERRGF

LCNKAKNVPCGDYGC*HVELRFLCEVPSWQLDPAQTYRVTWFISWSPC*FRRGCAGQVRVF

LQENKHVRLRIFAARIYDYDPLYQEALRTLRDAGAQVSIMTYEEFKHCWDTFVDRQGR

PFQPWDGLDEHSQALSGRLRAILQNGN
(italic: nucleic acid editing domain)

Bovine APOBEC-3A:
(SEQ ID NO: 136)
MDEYTFTENFNNQGWPSKTYLCYEMERLDGDATIPLDEYKGFVRNKGLDQPEKPC*HAE

LYFLGKIHSWNLDRNQHYRLTCFISWSPCY*DCAQKLTTFLKENHHISLHILASRIYTHNRFG

CHQSGLCELQAAGARITIMTFEDFKHCWETFVDHKGKPFQPWEGLNVKSQALCTELQA

ILKTQQN
(italic: nucleic acid editing domain)

Human APOBEC-3H:
(SEQ ID NO: 137)
MALLTAETFRLQFNNKRRLRRPYYPRKALLCYQLTPQNGSTPTRGYFENKKKC*HAEICF

INEIKSMGLDETQCYQVTCYLTWSPCSSC*AWELVDFIKAHDHLNLGIFASRLYYHWCKPQ

QKGLRLLCGSQVPVEVMGFPKFADCWENFVDHEKPLSFNPYKMLEELDKNSRAIKRRL

ERIKIPGVRAQGRYMDILCDAEV
(italic: nucleic acid editing domain)

Rhesus macaque APOBEC-3H:
(SEQ ID NO: 138)
MALLTAKTFSLQFNNKRRVNKPYYPRKALLCYQLTPQNGSTPTRGHLKNKKKDHAEIR

FINKIKSMGLDETQCYQVTCYLTWSPCPSCAGELVDFIKAHRHLNLRIFASRLYYHWRP

NYQEGLLLLCGSQVPVEVMGLPEFTDCWENFVDHKEPPSFNPSEKLEELDKNSQAIKRR

LERIKSRSVDVLENGLRSLQLGPVTPSSSIRNSR

Human APOBEC-3D:
(SEQ ID NO: 139)
MNPQIRNPMERMYRDTFYDNFENEPILYGRSYTWLCYEVKIKRGRSNLLWDTGVFRGP

VLPKRQSNHRQEVYFRFEN*HAEMCFLSWFCGNRLPANRRFQITWFVSWNPC*LPCVVKVT

-continued

KFLAEHPNVTLTISAARLYYYRDRDWRWVLLRLHKAGARVKIMDYEDFAYCWENFVC

NEGQPFMPWYKFDDNYASLHRTLKEILRNPMEAMYPHIFYFHFKNLLKACGRNESWLC

FTMEVTKHHSAVFRKRGVFRNQVDPETH*CHAERCFLSWFCDDILSPNTIVYEVTWYTSWSP*

*CPEC*AGEVAEFLARHSNVNLTIFTARLCYFWDTDYQEGLCSLSQEGASVKIMGYKDFV

SCWKNFVYSDDEPFKPWKGLQTNFRLLKRRLREILQ
(italic: nucleic acid editing domain)

Human APOBEC-1:
(SEQ ID NO: 140)
MTSEKGPSTGDPTLRRRIEPWEFDVFYDPRELRKEACLLYEIKWGMSRKIWRSSGKNTT

NHVEVNFIKKFTSERDFHPSMSCSITWFLSWSPCWECSQAIREFLSRHPGVTLVIYVARL

FWHMDQQNRQGLRDLVNSGVTIQIMRASEYYHCWRNFVNYPPGDEAHWPQYPPLWM

MLYALELHCIILSLPPCLKISRRWQNHLTFFRLHLQNCHYQTIPPHILLATGLIHPSVAWR

Mouse APOBEC-1:
(SEQ ID NO: 141)
MSSETGPVAVDPTLRRRIEPHEFEVFFDPRELRKETCLLYEINWGGRHSVWRHTSQNTS

NHVEVNFLEKFTTERYFRPNTRCSITWFLSWSPCGECSRAITEFLSRHPYVTLFIYIARLY

HHTDQRNRQGLRDLISSGVTIQIIVITEQEYCYCWRNFVNYPPSNEAYWPRYPHLWVKLY

VLELYCIILGLPPCLKILRRKQPQLTFFTITLQTCHYQRIPPHLLWATGLK

Rat APOBEC-1:
(SEQ ID NO: 142)
MSSETGPVAVDPTLRRRIEPHEFEVFFDPRELRKETCLLYEINWGGRHSIWRHTSQNTNK

HVEVNFIEKFTTERYFCPNTRCSITWFLSWSPCGECSRAITEFLSRYPHVTLFIYIARLYHH

ADPRNRQGLRDLISSGVTIQIMTEQESGYCWRNFVNYSPSNEAHWPRYPHLWVRLYVL

ELYCIILGLPPCLNILRRKQPQLTFFTIALQSCHYQRLPPHILWATGLK

Human APOBEC-2:
(SEQ ID NO: 143)
MAQKEEAAVATEAASQNGEDLENLDDPEKLKELIELPPFEIVTGERLPANFFKFQFRNV

EYSSGRNKTFLCYVVEAQGKGGQVQASRGYLEDEHAAAHAEEAFFNTILPAFDPALRY

NVTWYVSSSPCAACADRIIKTLSKTKNLRLLILVGRLFMWEEPEIQAALKKLKEAGCKL

RIMKPQDFEYVWQNFVEQEEGESKAFQPWEDIQENFLYYEEKLADILK

Mouse APOBEC-2:
(SEQ ID NO: 144)
MAQKEEAAEAAAPASQNGDDLENLEDPEKLKELIDLPPFEIVTGVRLPVNFFKFQFRNV

EYSSGRNKTFLCYVVEVQSKGGQAQATQGYLEDEHAGAHAEEAFFNTILPAFDPALKY

NVTWYVSSSPCAACADRILKTLSKTKNLRLLILVSRLFMWEEPEVQAALKKLKEAGCK

LRIMKPQDFEYIWQNFVEQEEGESKAFEPWEDIQENFLYYEEKLADILK

Rat APOBEC-2:
(SEQ ID NO: 145)
MAQKEEAAEAAAPASQNGDDLENLEDPEKLKELIDLPPFEIVTGVRLPVNFFKFQFRNV

EYSSGRNKTFLCYVVEAQSKGGQVQATQGYLEDEHAGAHAEEAFFNTILPAFDPALKY

NVTWYVSSSPCAACADRILKTLSKTKNLRLLILVSRLFMWEEPEVQAALKKLKEAGCK

LRIMKPQDFEYLWQNFVEQEEGESKAFEPWEDIQENFLYYEEKLADILK

Bovine APOBEC-2:
(SEQ ID NO: 146)
MAQKEEAAAAAEPASQNGEEVENLEDPEKLKELIELPPFEIVTGERLPAHYFKFQFRNV

EYSSGRNKTFLCYVVEAQSKGGQVQASRGYLEDEHATNHAEEAFFNSIMPTFDPALRY

MVTWYVSSSPCAACADRIVKTLNKTKNLRLLILVGRLFMWEEPEIQAALRKLKEAGCR

LRIMKPQDFEYIWQNFVEQEEGESKAFEPWEDIQENFLYYEEKLADILK

-continued

Petromyzon marinus CDA1 (pmCDA1)
(SEQ ID NO: 147)
MTDAEYVRIHEKLDIYTFKKQFFNNKKSVSHRCYVLFELKRRGERRACFWGYAVNK

PQSGTERGIHAEIFSIRKVEEYLRDNPGQFTINWYSSWSPCADCAEKILEWYNQELRG

NGHTLKIWACKLYYEKNARNQIGLWNLRDNGVGLNVMVSEHYQCCRKIFIQSSHNQ

LNENRWLEKTLKRAEKRRSELSFMIQVKILHTTKSPAV

Human APOBEC3G D316R D317R
(SEQ ID NO: 148)
MKPHFRNTVERMYRDTFSYNFYNRPILSRRNTVWLCYEVKTKGPSRPPLDAKIFRGQ

VYSELKYHPEMRFFHWFSKWRKLHRDQEYEVTWYISWSPCTKCTRDMATFLAEDP

KVTLTIFVARLYYFWDPDYQEALRSLCQKRDGPRATMKFNYDEFQHCWSKFVYSQ

RELFEPWNNLPKYYILLHFMLGEILRHSMDPPTFTFNFNNEPWVRGRHETYLCYEVER

MHNDTWVLLNQRRGFLCNQAPHKHGFLEGRHAELCFLDVIPFWKLDLDQDYRVTC

FTSWSPCFSCAQEMAKFISKKHVSLCIFTARIYRRQGRCQEGLRTLAEAGAKISFT

YSEFKHCWDTFVDHQGCPFQPWDGLDEHSQDLSGRLRAILQNQEN

Human APOBEC3G chain A
(SEQ ID NO: 149)
MDPPTFTFNFNNEPWWGRHETYLCYEVERMEINDTWVLLNQRRGFLCNQAPHKHG

FLEGRHAELCFLDVIPFWKLDLDQDYRVTCFTSWSPCFSCAQEMAKFISKNKHVSLCI

FTARIYDDQGRCQEGLRTLAEAGAKISF TYSEFKHCWDTFVDHQGCPFQPWDGLD

EHSQDLSGRLRAILQ

Human APOBEC3G chain A D120R D121R
(SEQ ID NO: 150)
MDPPTFTFNFNNEPWVRGRHETYLCYEVERMHNDTWVLLNQRRGFLCNQAPHKHG

FLEGRHAELCFLDVIPFWKLDLDQDYRVTCFTSWSPCFSCAQEMAKFISKNKHVSLCI

FTARIYRRQGRCQEGLRTLAEAGAKISFMTYSEFKHCWDTFVDHQGCPFQPWDGLDE

HSQDLSGRLRAILQ

Some aspects of the present disclosure are based on the recognition that modulating the deaminase domain catalytic activity of any of the fusion proteins described herein, for example, by making point mutations in the deaminase domain, affect the processivity of the fusion proteins (e.g., base editors). For example, mutations that reduce, but do not eliminate, the catalytic activity of a deaminase domain within a base editing fusion protein can make it less likely that the deaminase domain will catalyze the deamination of a residue adjacent to a target residue, thereby narrowing the deamination window. The ability to narrow the deamination window can prevent unwanted deamination of residues adjacent to specific target residues, which can decrease or prevent off-target effects.

By way of example, in some embodiments, an APOBEC deaminase incorporated into a base editor can comprise one or more mutations selected from the group consisting of H121X, H122X, R126X, R126X, RI 18X, W90X, W90X, and R132X of rAPOBEC1, or one or more corresponding mutations in another APOBEC deaminase, wherein X is any amino acid. In some embodiments, an APOBEC deaminase incorporated into a base editor can comprise one or more mutations selected from the group consisting of H121R, H122R, R126A, R126E, R118A, W90A, W90Y, and R132E of rAPOBEC1, or one or more corresponding mutations in another APOBEC deaminase.

In some embodiments, an APOBEC deaminase incorporated into a base editor can comprise one or more mutations selected from the group consisting of D316X, D317X, R320X, R320X, R313X, W285X, W285X, R326X of hAPOBEC3G, or one or more corresponding mutations in another APOBEC deaminase, wherein X is any amino acid. In some embodiments, any of the fusion proteins provided herein comprise an APOBEC deaminase comprising one or more mutations selected from the group consisting of D316R, D317R, R320A, R320E, R313A, W285A, W285Y, R326E of hAPOBEC3G, or one or more corresponding mutations in another APOBEC deaminase.

In some embodiments, an APOBEC deaminase incorporated into a base editor can comprise a H121R and a H122R mutation of rAPOBEC1, or one or more corresponding mutations in another APOBEC deaminase. In some embodiments an APOBEC deaminase incorporated into a base editor can comprise an APOBEC deaminase comprising a R126A mutation of rAPOBEC1, or one or more corresponding mutations in another APOBEC deaminase. In some embodiments, an APOBEC deaminase incorporated into a base editor can comprise an APOBEC deaminase comprising a R126E mutation of rAPOBEC1, or one or more corresponding mutations in another APOBEC deaminase. In some embodiments, an APOBEC deaminase incorporated into a base editor can comprise an APOBEC deaminase comprising a R118A mutation of rAPOBEC1, or one or more corresponding mutations in another APOBEC deaminase. In some embodiments, an APOBEC deaminase incorporated into a base editor can comprise an APOBEC deaminase comprising a W90A mutation of rAPOBEC1, or one or more corresponding mutations in another APOBEC deaminase. In some embodiments, an APOBEC deaminase incorporated into a base editor can comprise an APOBEC deaminase comprising a W90Y mutation of rAPOBEC1, or one or more corresponding mutations in another APOBEC deaminase. In some embodiments, an APOBEC deaminase incorporated into a base editor can comprise an APOBEC deaminase comprising a R132E mutation of rAPOBEC1, or one or more corresponding mutations in another APOBEC deaminase. In some embodiments an APOBEC deaminase incorporated into a base editor can comprise an APOBEC deaminase comprising a W90Y and a R126E mutation of rAPOBEC1, or one or more corresponding mutations in another APOBEC deaminase. In some embodiments, an APOBEC deaminase incorporated into a base editor can comprise an APOBEC deaminase comprising a R126E and a R132E mutation of rAPOBEC1, or one or more corresponding mutations in another APOBEC deaminase. In some embodiments, an APOBEC deaminase incorporated into a base editor can comprise an APOBEC deaminase comprising a W90Y and a R132E mutation of rAPOBEC1, or one or more corresponding mutations in another APOBEC deaminase. In some embodiments, an APOBEC deaminase incorporated into a base editor can comprise an APOBEC deaminase comprising a W90Y, R126E, and R132E mutation of rAPOBEC1, or one or more corresponding mutations in another APOBEC deaminase.

In some embodiments, an APOBEC deaminase incorporated into a base editor can comprise an APOBEC deaminase comprising a D316R and a D317R mutation of hAPOBEC3G, or one or more corresponding mutations in another APOBEC deaminase. In some embodiments, any of the fusion proteins provided herein comprise an APOBEC deaminase comprising a R320A mutation of hAPOBEC3G, or one or more corresponding mutations in another APOBEC deaminase. In some embodiments, an APOBEC deaminase incorporated into a base editor can comprise an APOBEC deaminase comprising a R320E mutation of hAPOBEC3G, or one or more corresponding mutations in another APOBEC deaminase. In some embodiments, an APOBEC deaminase incorporated into a base editor can comprise an APOBEC deaminase comprising a R313A mutation of hAPOBEC3G, or one or more corresponding mutations in another APOBEC deaminase. In some embodiments, an APOBEC deaminase incorporated into a base editor can comprise an APOBEC deaminase comprising a W285A mutation of hAPOBEC3G, or one or more corresponding mutations in another APOBEC deaminase. In some embodiments, an APOBEC deaminase incorporated into a base editor can comprise an APOBEC deaminase comprising a W285Y mutation of hAPOBEC3G, or one or more corresponding mutations in another APOBEC deaminase. In some embodiments, an APOBEC deaminase incorporated into a base editor can comprise an APOBEC deaminase comprising a R326E mutation of hAPOBEC3G, or one or more corresponding mutations in another APOBEC deaminase. In some embodiments, an APOBEC deaminase incorporated into a base editor can comprise an APOBEC deaminase comprising a W285Y and a R320E mutation of hAPOBEC3G, or one or more corresponding mutations in another APOBEC deaminase. In some embodiments, an APOBEC deaminase incorporated into a base editor can comprise an APOBEC deaminase comprising a R320E and a R326E mutation of hAPOBEC3G, or one or more corresponding mutations in another APOBEC deaminase. In some embodiments, an APOBEC deaminase incorporated into a base editor can comprise an APOBEC deaminase comprising a W285Y and a R326E mutation of hAPOBEC3G, or one or more corresponding mutations in another APOBEC deaminase. In some embodiments, an APOBEC deaminase incorporated into a base editor can comprise an APOBEC deaminase comprising a W285Y, R320E, and R326E mutation of hAPOBEC3G, or one or more corresponding mutations in another APOBEC deaminase.

A number of modified cytidine deaminases are commercially available, including, but not limited to, SaBE3, SaKKH-BE3, VQR-BE3, EQR-BE3, VRER-BE3, YE1-BE3, EE-BE3, YE2-BE3, and YEE-BE3, from Addgene (plasmids 85169, 85170, 85171, 85172, 85173, 85174, 85175, 85176, 85177).

Details of C to T nucleobase editing proteins are described in International PCT Application No. PCT/US2016/058344 (WO2017/070632) and Komor, A. C., et al., "Programmable editing of a target base in genomic DNA without double-stranded DNA cleavage" Nature 533, 420-424 (2016), the entire contents of which are hereby incorporated by reference.

A to G Editing

In some embodiments, a base editor described herein can comprise a deaminase domain which includes an adenosine deaminase. Such an adenosine deaminase domain of a base editor can facilitate the editing of an adenine (A) nucleobase to a guanine (G) nucleobase by deaminating the A to form inosine (I), which exhibits base pairing properties of G. Adenosine deaminase is capable of deaminating (i.e., removing an amine group) adenine of a deoxyadenosine residue in deoxyribonucleic acid (DNA).

In some embodiments, the nucleobase editors provided herein can be made by fusing together one or more protein domains, thereby generating a fusion protein. In certain embodiments, the fusion proteins provided herein comprise one or more features that improve the base editing activity (e.g., efficiency, selectivity, and specificity) of the fusion proteins. For example, the fusion proteins provided herein can comprise a Cas9 domain that has reduced nuclease activity. In some embodiments, the fusion proteins provided herein can have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand. In some embodiments, an A-to-G base editor further comprises an inhibitor of inosine base excision repair, for example, a uracil glycosylase inhibitor (UGI) domain or a catalytically inactive inosine specific nuclease. Without wishing to be bound by any particular theory, the UGI domain or catalytically inactive inosine specific nuclease can inhibit or prevent base excision repair of a deaminated adenosine residue (e.g., inosine), which can improve the activity or efficiency of the base editor.

A base editor comprising an adenosine deaminase can act on any polynucleotide, including DNA, RNA and DNA-RNA hybrids. In certain embodiments, a base editor comprising an adenosine deaminase can deaminate a target A of a polynucleotide comprising RNA. For example, the base editor can comprise an adenosine deaminase domain capable of deaminating a target A of an RNA polynucleotide and/or a DNA-RNA hybrid polynucleotide. In an embodiment, an adenosine deaminase incorporated into a base editor comprises all or a portion of adenosine deaminase acting on RNA (ADAR, e.g., ADAR1 or ADAR2). In another embodiment, an adenosine deaminase incorporated into a base editor comprises all or a portion of adenosine deaminase acting on tRNA (ADAT). A base editor comprising an adenosine deaminase domain can also be capable of deaminating an A nucleobase of a DNA polynucleotide. In an embodiment, an adenosine deaminase domain of a base editor comprises all or a portion of an ADAT comprising one or more mutations which permit the ADAT to deaminate a target A in DNA. For example, the base editor can comprise all or a portion of an ADAT from Escherichia coli (EcTadA) comprising one or more of the following mutations: D108N, A106V, D147Y, E155V, L84F, H123Y, I157F, or a corresponding mutation in another adenosine deaminase. In some embodiments, the TadA deaminase is an E. coli TadA (ecTadA) deaminase or a fragment thereof. For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine. In some embodiments, the TadA deaminase is an N-terminal truncated TadA. In particular embodiments, the TadA is any one of the TadA described in PCT/US2017/045381, which is incorporated herein by reference in its entirety.

The adenosine deaminase can be derived from any suitable organism. In some embodiments, the adenosine deaminase is from a prokaryote. In some embodiments, the adenosine deaminase is from a bacterium. In some embodiments, the adenosine deaminase is from Escherichia coli, Staphylococcus aureus, Salmonella typhi, Shewanella putrefaciens, Haemophilus influenzae, Caulobacter crescentus, or Bacillus subtilis. In some embodiments, the adenosine deaminase is from E. coli. In some embodiments, the adenine deaminase is a naturally-occurring adenosine deaminase that includes one or more mutations corresponding to any of the mutations provided herein (e.g., mutations in ecTadA). The corresponding residue in any homologous protein can be identified by e.g., sequence alignment and determination of homologous residues. The mutations in any naturally-occurring adenosine deaminase (e.g., having homology to ecTadA) that corresponds to any of the mutations described herein (e.g., any of the mutations identified in ecTadA) can be generated accordingly.

TadA (tRNA Adenosine Deaminase A)

In particular embodiments, the TadA is any one of the TadAs described in PCT/US2017/045381 (WO 2018/027078), which is incorporated herein by reference in its entirety.

In one embodiment, a fusion protein of the invention comprises a wild-type TadA linked to TadA7.10, which is linked to Cas9 nickase. In particular embodiments, the fusion proteins comprise a single TadA7.10 domain (e.g., provided as a monomer). In other embodiments, the ABE7.10 editor comprises TadA7.10 and TadA(wt), which are capable of forming heterodimers. The relevant amino acid sequences follow: (M)SEVEFSHEYWMRHALT-LAKRAWDEREVPVGAVLVHNNRVIGEGWNRPI-GRHDPTA HAEIMALRQGGLVMQNYRLIDATLY-VTLEPCVMCAGAMIHSRIGRVVFGARDAKTGA AGSLMDVLHHPGMNHRVEITEGILADE-CAALLSDFFRMRRQEIKAQKKAQSSTD (SEQ ID NO: 151), which is termed "the TadA reference sequence" or wild type TadA (TadA(wt)). The TadA7.10 amino acid sequence:

```
                                          (SEQ ID NO: 152)
(M)SEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSRIG

RVVFGVRNAKTGAAGSLMDVLHYPGMNHRVEITEGILADECAALLCYFFRM

PRQVFNAQKKAQSSTD
```

In some embodiments, the adenosine deaminase comprises an an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In some embodiments the TadA deaminase is a full-length E. coli TadA deaminase. For example, in certain embodiments, the adenosine deaminase comprises the amino acid sequence:

```
                                          (SEQ ID NO: 153)
MRRAFITGVFELSEVEFSHEYWMRHALTLAKRAWDEREVPVGAVLVHNNRV

IGEGWNRPIGRHDPTAHAEIMALRQGGLVMQNYRLIDATLYVTLEPCVMCA

GAMIHSRIGRVVFGARDAKTGAAGSLMDVLHHPGMNHRVEITEGILADECA

ALLSDFFRMRRQEIAQKKAQSSTD.
```

It will be appreciated that additional adenosine deaminases useful in the present application would be apparent to the skilled artisan and are within the scope of this disclosure. For example, the adenosine deaminase may be a homolog of adenosine deaminase acting on tRNA (AD AT). Without limitation, the amino acid sequences of exemplary AD AT homologs include the following:

Staphylococcus aureus TadA:
(SEQ ID NO: 154)
MGSHMTNDIYFMTLAIEEAKKAAQLGEVPIGAIITKDDEVIARAHNLRETL

QQPTAHAEHIAIERAAKVLGSWRLEGCTLYVTLEPCVMCAGTIVMSRIPRV

VYGADDPKGGCS GSLMNLLQQS NFNHRAIVDKG VLKE AC S TLLTT

FFKNLRANKKS TN

Bacillus subtilis TadA:
(SEQ ID NO: 155)
MTQDELYMKEAIKEAKKAEEKGEVPIGAVLVINGEIIARAHNLRETEQRSI

AHAEMLVIDEACKALGTWRLEGATLYVTLEPCPMCAGAVVLSRVEKVVFGA

FDPKGGC SGTLMN LLQEERFNHQAEVVSGVLEEECGGMLSAFFRELRKK

KKAARKNLSE

Salmonella typhimurium (S. typhimurium) TadA:
(SEQ ID NO: 156)
MPPAFITGVTSLSDVELDHEYWMRHALTLAKRAWDEREVPVGAVLVHNHRV

IGEGWNRPIGRHDPTAHAEIMALRQGGLVLQNYRLLDTTLYVTLEPCVMCA

GAMVHSRIGRVVFGARDAKTGAAGSLIDVLHHPGMNHRVEIIEGVLRDECA

TLLSDFFRMRRQEIKALKKADRAEGAGPAV

Shewanella putrefaciens (S. putrefaciens) TadA:
(SEQ ID NO: 157)
MDE YWMQVAMQM AEKAEAAGE VPVGA VLVKDGQQIATGYNLS IS Q

HDPTAHAEILCLRSAGKKLENYRLLDATLYITLEPCAMCAGAMVHSRIARV

VYGARDEKTGAAGTVVNLLQHPAFNHQVEVTSGVLAEACSAQLSRFFKRRR

DEKKALKLAQRAQQGIE

Haemophilus influenzae F3031 (H. influenzae) TadA:
(SEQ ID NO: 158)
MDAAKVRSEFDEKMMRYALELADKAEALGEIPVGAVLVDDARNIIGEGWNL

SIVQSDPTAHAEIIALRNGAKNIQNYRLLNSTLYVTLEPCTMCAGAILHS

RIKRLVFGASDYKTGAIGSRFHFFDDYKMNHTLEITSGVLAEECSQKLSTF

FQKRREEKKIEKALLKSLSDK

Caulobacter crescentus (C. crescentus) TadA:
(SEQ ID NO: 159)
MRTDESEDQDHRMMRLALDAARAAAEAGETPVGAVILDPSTGEVIATAGNG

PIAAHDPTAHAEIAAMRAAAAKLGNYRLTDLTLVVTLEPCAMCAGAISHAR

IGRVVFGADDPKGGAVVHGPKFFAQPTCHWRPEVTGGVLADESADLLRGFF

RARRKAKI

Geobacter sulfurreducens (G. sulfurreducens) TadA:
(SEQ ID NO: 160)
MSSLKKTPIRDDAYWMGKAIREAAKAAARDEVPIGAVIVRDGAVIGRGHNL

REGSNDPSAHAEMIAIRQAARRSANWRLTGATLYVTLEPCLMCMGAIILAR

LERVVFGCYDPKGGAAGSLYDLSADPRLNHQVRLSPGVCQEECGTMLSDFF

RDLRRRKKAKATPALFIDERKVPPEP.

E. coli TadA (ecTadA):
(SEQ ID NO: 161)
MSEVEFSHEYWMRHALTLAKRARDEREVPVGAVLVLNNRVIGEGWNRAIGL

HDPTAHAEIMALRQGGLVMQNYRLIDATLYVTFEPCVMCAGAMIHSRIGRV

VFGVRNAKTGAAGSLMDVLHYPGMNHRVEITEGILADECAALLCYFFRMPR

QVFNAQKKAQSSTD.

In some embodiments, the adenosine deaminase comprises a D108X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation relative to the TadA reference sequence, or a corresponding mutation in another adenosine deaminase. It should be appreciated, however, that additional deaminases may similarly be aligned to identify homologous amino acid residues that can be mutated as provided herein.

In some embodiments, the adenosine deaminase comprises an A106X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an A106V mutation relative to the TadA reference sequence, or a corresponding mutation in another adenosine deaminase.

In some embodiments, the adenosine deaminase comprises a E155X mutation relative to the TadA reference sequence, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation relative to the TadA reference sequence, or a corresponding mutation in another adenosine deaminase.

In some embodiments, the adenosine deaminase comprises a D147X mutation relative to the TadA reference sequence, or a corresponding mutation in another adenosine deaminase, where the presence of X indicates any amino acid other than the corresponding amino acid in the wild-type adenosine deaminase. In some embodiments, the adenosine deaminase comprises a D147Y, mutation relative to the TadA reference sequence, or a corresponding mutation in another adenosine deaminase.

It should be appreciated that any of the mutations provided herein (e.g., based on the amino acid sequence of TadA reference sequence) may be introduced into other adenosine deaminases, such as S. aureus TadA (saTadA), or other adenosine deaminases (e.g., bacterial adenosine deaminases). It would be apparent to the skilled artisan how to identify sequences that are homologous to the mutated residues in the TadA reference sequence. Thus, any of the mutations identified relative to the TadA reference sequence may be made in other adenosine deaminases that have homologous amino acid residues. It should also be appreciated that any of the mutations provided herein may be made individually or in any combination in TadA or another adenosine deaminase. For example, an adenosine deaminase may contain a D108N, a A106V, a E155V, and/or a D147Y mutation relative to the TadA reference sequence, or a corresponding mutation in another adenosine deaminase. In some embodiments, an adenosine deaminase comprises the following group of mutations (groups of mutations are separated by a ";") relative to the TadA reference sequence, or corresponding mutations in another adenosine deaminase: D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D147Y; and D108N, A106V, E55V, and D147Y. It should be appreciated, however, that any combination of corresponding mutations provided herein may be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, I156X, and/or K157X mutation relative to the TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, I95I, V102A, F104L, A106V, R107C, or R107H, or R107P, D108G, or D108N, or D108V, or D108A, or D108Y, K110I, M118K, N127S, A138V, F149Y, M151V, R153C, Q154L, I156D, and/or K157R mutation relative to the TadA reference sequence, or one or more corresponding mutations in another adenosine deaminase.

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, I156X, and/or K157X mutation relative to the TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, I95I, V102A, F104L, A106V, R107C, or R107H, or R107P, D108G, or D108N, or D108V, or D108A, or D108Y, K110I, M118K, N127S, A138V, F149Y, M151V, R153C, Q154L, I156D, and/or K157R mutation relative to the TadA reference sequence, or one or more corresponding mutations in another adenosine deaminase. In some embodiments, the adenosine deaminase comprises one or more of a H8X, D108X, and/or N127X mutation relative to the TadA reference sequence, or one or more corresponding mutations in another adenosine deaminase, where X indicates the presence of any amino acid. In some embodiments, the adenosine deaminase comprises one or more of a H8Y, D108N, and/or N127S mutation relative to the TadA reference sequence, or one or more corresponding mutations in another adenosine deaminase.

In some embodiments, the adenosine deaminase comprises one or more of H8X, D108X, and/or N127X mutation relative to the TadA reference sequence, or one or more corresponding mutations in another adenosine deaminase, where X indicates the presence of any amino acid. In some embodiments, the adenosine deaminase comprises one or more of a H8Y, D108N, and/or N127S mutation relative to the TadA reference sequence, or one or more corresponding mutations in another adenosine deaminase.

In some embodiments, the adenosine deaminase comprises one or more of H8X, D108X, and/or N127X mutation relative to the TadA reference sequence, or one or more corresponding mutations in another adenosine deaminase, where X indicates the presence of any amino acid. In some embodiments, the adenosine deaminase comprises one or more of a H8Y, D108N, and/or N127S mutation relative to the TadA reference sequence, or one or more corresponding mutations in another adenosine deaminase.

In some embodiments, the adenosine deaminase comprises one or more of H8X, D108X, and/or N127X mutation relative to the TadA reference sequence, or one or more corresponding mutations in another adenosine deaminase, where X indicates the presence of any amino acid. In some embodiments, the adenosine deaminase comprises one or more of a H8Y, D108N, and/or N127S mutation relative to the TadA reference sequence, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X relative to the TadA reference sequence, or a corresponding mutation or mutations in another adenosine deaminase, where X indicates the presence of any amino acid other than the corresponding amino acid in the reference or wild-type adenosine deaminase. In some embodiments, the adenosine deaminase comprises one, two, three, four, five, or six mutations selected from the group consisting of H8X, A106X, D108X, mutation relative to the Tad reference sequence, or mutations in another adenosine deaminase, where X indicates the presence of any amino acid other than the corresponding amino acid in the reference or wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X relative to the TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H relative to the TadA reference sequence, or a corresponding mutation or mutations in another adenosine deaminase. In some embodiments, the adenosine deaminase comprises one, two, three, four, five, six, seven, or eight mutations selected from the group consisting of H8Y, M61I, M70V, D108N, N127S, Q154R, E155G and Q163H relative to the TadA reference sequence, or a corresponding mutation or mutations in another adenosine deaminase. In some embodiments, the adenosine deaminase comprises one, two, three, four, or five, mutations selected from the group consisting of H8Y, D108N, N127S, E155V, and T166P relative to the TadA reference sequence, or a corresponding mutation or mutations in another adenosine deaminase. In some embodiments, the adenosine deaminase comprises one, two, three, four, five, or six mutations selected from the group consisting of H8Y, A106T, D108N, N127S, E155D, and K161Q relative to the TadA reference sequence, or a corresponding mutation or mutations in another adenosine deaminase. In some embodiments, the adenosine deaminase comprises one, two, three, four, five, six, seven, or eight mutations selected from the group consisting of H8Y, R126W, L68Q, D108N, N127S, D147Y, and E155V relative to the TadA reference sequence, or a corresponding mutation or mutations in another adenosine deaminase. In some embodiments, the adenosine deaminase comprises one, two, three, four, or five, mutations selected from the group consisting of H8Y, D108N, A109T, N127S, and E155G relative to the TadA reference sequence, or a corresponding mutation or mutations in another adenosine deaminase.

In some embodiments, the adenosine deaminase comprises one or more of the or one or more corresponding mutations in another adenosine deaminase. In some embodiments, the adenosine deaminase comprises a D108N, D108G, or D108V mutation relative to the TadA reference sequence, or corresponding mutations in another adenosine deaminase. In some embodiments, the adenosine deaminase comprises a A106V and D108N mutation relative to the TadA reference sequence, or corresponding mutations in another adenosine deaminase. In some embodiments, the adenosine deaminase comprises R107C and D108N mutations relative to the TadA reference sequence, or corresponding mutations in another adenosine deaminase. In some embodiments, the adenosine deaminase comprises a H8Y, D108N, N127S, D147Y, and Q154H mutation relative to the TadA reference sequence, or corresponding mutations in another adenosine deaminase. In some embodiments, the adenosine deaminase comprises a H8Y, R24W, D108N, N127S, D147Y, and E155V mutation relative to the TadA reference sequence, or corresponding mutations in another adenosine deaminase. In some embodiments, the adenosine deaminase comprises a D108N, D147Y, and E155V mutation relative to the TadA reference sequence, or corresponding mutations in another adenosine deaminase. In some embodiments, the adenosine deaminase comprises a H8Y, D108N, and N127S mutation relative to the TadA reference sequence, or corresponding mutations in another adenosine deaminase. In some embodiments, the adenosine deaminase comprises a A106V, D108N, D147Y and E155V mutation relative to the TadA reference sequence, or corresponding mutations in another adenosine deaminase.

In some embodiments, the adenosine deaminase comprises one or more of a, S2X, H8X, I49X, L84X, H123X, N127X, I156X and/or K160X mutation relative to the TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, I156F and/or K160S mutation relative to the TadA reference sequence, or one or more corresponding mutations in another adenosine deaminase.

In some embodiments, the adenosine deaminase comprises an L84X mutation adenosine deaminase, where X indicates any amino acid other than the corresponding amino acid in the wild-type adenosine deaminase. In some embodiments, the adenosine deaminase comprises an L84F mutation relative to the TadA reference sequence, or a corresponding mutation in another adenosine deaminase.

In some embodiments, the adenosine deaminase comprises an H123X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an H123Y mutation relative to the TadA reference sequence, or a corresponding mutation in another adenosine deaminase.

In some embodiments, the adenosine deaminase comprises an I157X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an I157F mutation relative to the TadA reference sequence, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and I156X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X relative to the TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F relative to the TadA reference sequence, or a corresponding mutation or mutations in another adenosine deaminase. In some embodiments, the adenosine deaminase comprises one, two, three, four, five, or six mutations selected from the group consisting of S2A, I49F, A106V, D108N, D147Y, and E155V relative to the TadA reference sequence.

In some embodiments, the adenosine deaminase comprises one, two, three, four, or five, mutations selected from the group consisting of H8Y, A106T, D108N, N127S, and K160S relative to the TadA reference sequence, or a corresponding mutation or mutations in another adenosine deaminase.

In some embodiments, the adenosine deaminase comprises one or more of a E25X, R26X, R107X, A142X, and/or A143X mutation relative to the TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R07K, R107A, R107N, R107W, R107H, R107S, A142N, A142D, A142G, A143D, A143G, A143E, A143L, A143W, A143M, A143S, A143Q and/or A143R mutation relative to the TadA reference sequence, or one or more corresponding mutations in another adenosine deaminase. In some embodiments, the adenosine deaminase comprises one or more of the mutations described herein corresponding to the TadA reference sequence, or one or more corresponding mutations in another adenosine deaminase.

In some embodiments, the adenosine deaminase comprises an E25X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an E25M, E25D, E25A, E25R, E25V, E25S, or E25Y mutation relative to the TadA reference sequence, or a corresponding mutation in another adenosine deaminase.

In some embodiments, the adenosine deaminase comprises an R26X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises R26G, R26N, R26Q, R26C, R26L, or R26K mutation relative to the TadA reference sequence, or a corresponding mutation in another adenosine deaminase.

In some embodiments, the adenosine deaminase comprises an R107X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an R107P, R07K, R107A, R107N, R107W, R107H, or R107S mutation relative to the TadA reference sequence, or a corresponding mutation in another adenosine deaminase.

In some embodiments, the adenosine deaminase comprises an A142X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation relative to the TadA reference sequence, or a corresponding mutation in another adenosine deaminase.

In some embodiments, the adenosine deaminase comprises an A143X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation relative to the TadA reference sequence, or a corresponding mutation in another adenosine deaminase.

In some embodiments, the adenosine deaminase comprises one or more of a H36X, N37X, P48X, I49X, R51X, M70X, N72X, D77X, E134X, S146X, Q154X, K157X, and/or K161X mutation relative to the TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S146R, S146C, Q154H, K157N, and/or K161T mutation relative to the TadA reference sequence, or one or more corresponding mutations in another adenosine deaminase.

In some embodiments, the adenosine deaminase comprises an H36X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an H36L mutation relative to the TadA reference sequence, or a corresponding mutation in another adenosine deaminase.

In some embodiments, the adenosine deaminase comprises an N37X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an N37T, or N37S mutation relative to the TadA reference sequence, or a corresponding mutation in another adenosine deaminase.

In some embodiments, the adenosine deaminase comprises an P48X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an P48T, or P48L mutation relative to the TadA reference sequence, or a corresponding mutation in another adenosine deaminase.

In some embodiments, the adenosine deaminase comprises an R51X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an R51H, or R51L mutation relative to the TadA reference sequence, or a corresponding mutation in another adenosine deaminase.

In some embodiments, the adenosine deaminase comprises an S146X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an S 146R, or S 146C mutation relative to the TadA reference sequence, or a corresponding mutation in another adenosine deaminase.

In some embodiments, the adenosine deaminase comprises an K157X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises a K157N mutation relative to the TadA reference sequence, or a corresponding mutation in another adenosine deaminase.

In some embodiments, the adenosine deaminase comprises an P48X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises a P48S, P48T, or P48A mutation relative to the TadA reference sequence, or a corresponding mutation in another adenosine deaminase.

In some embodiments, the adenosine deaminase comprises an A142X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises a A142N mutation relative to the TadA reference sequence, or a corresponding mutation in another adenosine deaminase.

In some embodiments, the adenosine deaminase comprises an W23X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises a W23R, or W23L mutation relative to the TadA reference sequence, or a corresponding mutation in another adenosine deaminase.

In some embodiments, the adenosine deaminase comprises an R152X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises a R152P, or R52H mutation relative to the TadA reference sequence, or a corresponding mutation in another adenosine deaminase.

In one embodiment, the adenosine deaminase may comprise the mutations H36L, R51L, L84F, A106V, D108N, H123Y, S 146C, D147Y, E155V, I156F, and K157N. In some embodiments, the adenosine deaminase comprises the following combination of mutations relative to TadA reference sequence, where each mutation of a combination is separated by a "_" and each combination of mutations is between parentheses: (A106V_D108N), (R107C_D108N), (H8Y_D108N_N127S_D147Y_Q154H), (H8Y_R24W_D108N_N127S_D147Y_E155V), (D108N_D147Y_E155V), (H8Y_D108N_N127S), (H8Y_D108N_N127S_D147Y_Q154H), (A106V_D108N_D147Y_E155V) (D108Q_D147Y_E155V) (D108M_D147Y_E155V), (D108L_D147Y_E155V), (D108K_D147Y_E155V), (D108I_D147Y_E155V), (D108F_D147Y_E155V), (A106V_D108N_D147Y), (A106V_D108M_D147Y_E155V), (E59A_A106V_D108N_D147Y_E155V), (E59A cat dead_A106V_D108N_D147Y_E155V), (L84F_A106V_D108N_H123Y_D147Y_E155V_I156Y), (L84F_A106V_D108N_H123Y_D147Y_E155V_I156F), (D103A_D104N), (G22P_D103A_D104N), (G22P_D103A_D104N_S138 A), (D103 A_D104N_S138A), (R26G_L84F_A106V_R107H_D108N_H123Y_A142N_ A143D_D147Y_E155V_I156F), (E25G_R26G_L84F_A106V_R107H_D108N_H123Y_ A142N_A143D_D147Y_E155V_I156F), (E25D_R26G_L84F_A106V_R107K_D108N_H123Y_ A142N_A143G_D147Y_E155V_I156F), (R26Q_L84F_A106V_D108N_H123Y_A142N_D147Y_ E155V_I156F), (E25M_R26G_L84F_A106V_R107P_D108N_H123Y_ A142N_A143D_D147Y_E155V_I156F), (R26C_L84F_A106V_R107H_D108N_H123Y_A142N_ D147Y_E155V_I156F), (L84F_A106V_D108N_H123Y_A142N_A143L_D147Y_ E155V_I156F), (R26G_L84F_A106V_D108N_H123Y_A142N_D147Y_ E155V_I156F),
(E25A_R26G_L84F_A106V_R107N_D108N_H123Y_ A142N_A143E_D147Y_E155V_I156F), (R26G_L84F_A106V_R107H_D108N_H123Y_A142N_ A143D_D147Y_E155V_I156F), (A106V_D108N_A142N_D147Y_E155V), (R26G_A106V_D108N_A142N_D147Y_E155V), (E25D_R26G_A106V_R107K_D108N_A142N_A143G_ D147Y_E155V), (R26G_A106V_D108N_R107H_A142N_A143D_D147Y_ E155V), (E25D_R26G_A106V_D108N_A142N_D147Y_E155V), (A106V_R107K_D108N_A142N_D147Y_E155V), (A106V_D108N_A142N_A143G_D147Y_E155V), (A106V_D108N_A142N_A143L_D147Y_E155V), (H36L_R51L_L84F_A106V_D108N_H123Y_S146C_ D147Y_E155V_I156F_K157N), (N37T_P48T_M70L_L84F_A106V_D108N_H123Y_ D147Y_I49V_E155V_I156F), (N37S_L84F_A106V_D108N_H123Y_D147Y_E155V_ I156F_K161T), (H36L_L84F_A106V_D108N_H123Y_D147Y_Q154H_ E155V_I156F), (N72S_L84F_A106V_D108N_H123Y_S146R_D147Y_ E155V_I156F), (H36L_P48L_L84F_A106V_D108N_H123Y_E134G_ D147Y_E155V_I156F_K157N), (H36L_L84F_A106V_D108N_H123Y_S146C_D147Y_ E155V_I156F), (L84F_A106V_D108N_H123Y_S146R_D147Y_E155V_ I156F_K161T), (N37S_R51H_D77G_L84F_A106V_D108N_H123Y_ D147Y_E155V_I156F), (R51L_L84F_A106V_D108N_H123Y_D147Y_E155V_ I156F_K157N), (D24G_Q71R_L84F_H96L_A106V_D108N_H123Y_ D147Y_E155V_I156F_K160E), (H36L_G67V_L84F_A106V_D108N_H123Y_S146T_ D147Y_E155V_I156F), (Q71L_L84F_A106V_D108N_H123Y_L137M_A143E_ D147Y_E155V_I156F), (E25G_L84F_A106V_D108N_H123Y_D147Y_ E155V_I156F_Q159L), (L84F_A91T_F104I_A106V_D108N_H123Y_D147Y_ E155V_I156F), (N72D_L84F_A106V_D108N_H123Y_G125A_ D147Y_E155V_I156F), (P48S_L84F_S97C_A106V_D108N_H123Y_D147Y_ E155V_I156F), (W23G_L84F_A106V_D108N_H123Y_D147Y_ E155V_I156F), (D24G_P48L_Q71R_L84F_A106V_D108N_H123Y_ D147Y_E155V_I156F_Q159L), (L84F_A106V_D108N_H123Y_A142N_D147Y_ E155V_I156F), (H36L_R51L_L84F_A106V_D108N_H123Y_A142N_ S146C_D147Y_E155V_I156F_K157N), (N37S_L84F_A106V_D108N_H123Y_A142N_D147Y_ E155V_I156F_K161T), (L84F_A106V_D108N_D147Y_E155V_I156F), (R51L_L84F_A106V_D108N_H123Y_S146C_ D147Y_E155V_I156F_K157N_K161T), (L84F_A106V_D108N_H123Y_S146C_D147Y_ E155V_I156F_K161T), (L84F_A106V_D108N_H123Y_S146C_D147Y_ E155V_I156F_K157N_K160E_K161T), (L84F_A106V_D108N_H123Y_S146C_D147Y_ E155V_I156F_K157N_K160E), (R74Q L84F_A106V_D108N_H123Y_D147Y_E155V_I156F), (R74A_L84F_A106V_D108N_H123Y_D147Y_E155V_I156F), (L84F_A106V_D108N_H123Y_D147Y_E155V_I156F), (R74Q_L84F_A106V_D108N_H123Y_D147Y_E155V_I156F), (L84F_R98Q_A106V_D108N_H123Y_D147Y_E155V_I156F), (L84F_A106V_D108N_H123Y_R129Q_D147Y_E155V_I156F), (P48S_L84F_A106V_D108N_H123Y_A142N_D147Y_E155V_I156F), (P48S_A142N), (P48T_I49V_L84F_A106V_D108N_H123Y_A142N_q D147Y_E155V_I156F_L157N), (P48T_I49V_A142N), (H36L_P48S_R51L_L84F_A106V_D108N_H123Y_S146C_D147Y_E155V_I156F_K157N), (H36L_P48S_R51L_L84F_A106V_D108N_H123Y_S146C_A142N_D147Y_E155V_I156F (H36L_P48T_I49V_R51L_L84F_A106V_D108N_H123Y_S146C_D147Y_E155V_I156F_K157N), (H36L_P48T_I49V_R51L_L84F_A106V_D108N_H123Y_A142N_S146C_D147Y_E155V_I156F_K157N), (H36L_P48A_R51L_L84F_A106V_D108N_H123Y_S146C_D147Y_E155V_I156F_K157N), (H36L_P48A_R51L_L84F_A106V_D108N_H123Y_A142N_S146C_D147Y_E155V_I156F_K157N), (H36L_P48A_R51L_L84F_A106V_D108N_H123Y_S146C_A142N_D147Y_E155V_I156F_K157N), (W23L_H36L_P48A_R51L_L84F_A106V_D108N_H123Y_S146C_D147Y_E155V_I156F_K157N), (W23R_H36L_P48A_R51L_L84F_A106V_D108N_H123Y_S146C_D147Y_E155V_I156F_K157N), (W23L_H36L_P48A_R51L_L84F_A106V_D108N_H123Y_S146R_D147Y_E155V_I156F_K161T), (H36L_P48A_R51L_L84F_A106V_D108N_H123Y_S146C_D147Y_R152H_E155V_I156F_K157N), (H36L_P48A_R51L_L84F_A106V_D108N_H123Y_S146C_D147Y_R152P_E155V_I156F_K157N), (W23L_H36L_P48A_R51L_L84F_A106V_D108N_H123Y_S146C_D147Y_R152P_E155V_I156F_K157N), (W23L_H36L_P48A_R51L_L84F_A106V_D108N_H123Y_A142A_S146C_D147Y_E155V_I156F_K157N), (W23L_H36L_P48A_R51L_L84F_A106V_D108N_H123Y_A142A_S146C_D147Y_R152P_E155V_II56F_K157N), (W23L_H36L_P48A_R51L_L84F_A106V_D108N_H123Y_S146R_D147Y_E155V_I156F_K161T), (W23R_H36L_P48A_R51L_L84F_A106V_D108N_H123Y_S146C_D147Y_R152P_E155V_I156F_K157N), (H36L_P48A_R51L_L84F_A106V_D108N_H123Y_A142N_S146C_D147Y_R152P_E155V_I156F_K157N).

In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

In some embodiments, the adenosine deaminase comprises a D108X mutation relative to the TadA reference or wild type sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a D108G, D108N, D108V, D108A, or D108Y mutation, or a corresponding mutation in another adenosine deaminase.

In some embodiments, the adenosine deaminse comprises an A106X, E155X, or D147X, mutation relative to the TadA reference or wild type sequence, or a corresponding mutation in another adenosine deaminase, where X indicates any amino acid other than the corresponding amino acid in the wild-type adenosine deaminase. In some embodiments, the adenosine deaminase comprises an E155D, E155G, or E155V mutation. In some embodiments, the adenosine deaminase comprises a D147Y.

It should be appreciated that any of the mutations provided herein (e.g., based on the TadA reference amino acid sequence) can be introduced into other adenosine deaminases, such as S. aureus TadA (saTadA), or other deaminases (e.g., bacterial adenosine deaminases). Any of the mutations identified based on the TadA reference sequence can be made in other adenosine deaminases that have homologous amino acid residues. It should also be appreciated that any of the mutations provided herein can be made individually or in any combination relative to the TadA or another adenosine deaminase.

For example, an adenosine deaminase can contain a D108N, a A106V, a E155V, and/or a D147Y mutation relative to the TadA reference sequence, or a corresponding mutation in another adenosine deaminase. In some embodiments, an adenosine deaminase comprises the following group of mutations (groups of mutations are separated by a ";") relative to the TadA reference sequence, or corresponding mutations in another adenosine deaminase: D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D 147Y; and D108N, A106V, E55V, and D147Y. It should be appreciated, however, that any combination of corresponding mutations provided herein can be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K101X, M118X, N127X, A138X, F149X, M151X, R153X, Q154X, I156X, and/or K157X mutation relative to the TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, I95I, V102A, F104L, A106V, R107C, or R107H, or R107P, D108G, or D108N, or D108V, or D108A, or D108Y, K110I, Ml18K, N127S, A138V, F149Y, M151V, R153C, Q154L, I156D, and/or K157R mutation relative to the TadA reference sequence, or one or more corresponding mutations in another adenosine deaminase. In some embodiments, the adenosine deaminase comprises one or more of a H8X, D108X, and/or N127X mutation relative to the TadA reference sequence, or one or more corresponding mutations in another adenosine deaminase, where X indicates the presence of any amino acid. In some embodiments, the adenosine deaminase comprises one or more of a H8Y, D108N, and/or N127S mutation relative to the TadA reference sequence, or one or more corresponding mutations in another adenosine deaminase.

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation relative to the TadA reference sequence, or one or more corresponding mutations in another adenosine deaminase, where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation relative to the TadA reference sequence, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X relative to the TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8X, A106X, D108X, mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X relative to the TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H relative to the TadA reference sequence, or a corresponding mutation or mutations in another adenosine deaminase. In some embodiments, the adenosine deaminase comprises one, two, three, four, five, six, seven, or eight mutations selected from the group consisting of H8Y, M61I, M70V, D108N, N127S, Q154R, E155G and Q163H relative to the TadA reference sequence, or a corresponding mutation or mutations in another adenosine deaminase. In some embodiments, the adenosine deaminase comprises one, two, three, four, or five, mutations selected from the group consisting of H8Y, D108N, N127S, E155V, and T166P relative to the TadA reference sequence, or a corresponding mutation or mutations in another adenosine deaminase. In some embodiments, the adenosine deaminase comprises one, two, three, four, five, or six mutations selected from the group consisting of H8Y, A106T, D108N, N127S, E155D, and K161Q relative to the TadA reference sequence, or a corresponding mutation or mutations in another adenosine deaminase. In some embodiments, the adenosine deaminase comprises one, two, three, four, five, six, seven, or eight mutations selected from the group consisting of H8Y, R126W, L68Q, D108N, N127S, D147Y, and E155V relative to the TadA reference sequence, or a corresponding mutation or mutations in another adenosine deaminase. In some embodiments, the adenosine deaminase comprises one, two, three, four, or five, mutations selected from the group consisting of H8Y, D108N, A109T, N127S, and E155G relative to the TadA reference sequence, or a corresponding mutation or mutations in another adenosine deaminase.

Any of the mutations provided herein and any additional mutations (e.g., based on the ecTadA amino acid sequence) can be introduced into any other adenosine deaminases. Any of the mutations provided herein can be made individually or in any combination relative to the TadA reference sequence or another adenosine deaminase.

Details of A to G nucleobase editing proteins are described in International PCT Application No. PCT/2017/045381 (WO 2018/027078) and Gaudelli, N. M., et al., "Programmable base editing of A•T to G•C in genomic DNA without DNA cleavage" Nature, 551, 464-471 (2017), the entire contents of which are hereby incorporated by reference.

Cytidine Deaminase

In one embodiment, a fusion protein of the invention comprises a cytidine deaminase. In some embodiments, the cytidine deaminases provided herein are capable of deaminating cytosine or 5-methylcytosine to uracil or thymine. In some embodiments, the cytosine deaminases provided herein are capable of deaminating cytosine in DNA. The cytidine deaminase may be derived from any suitable organism. In some embodiments, the cytidine deaminase is a naturally-occurring cytidine deaminase that includes one or more mutations corresponding to any of the mutations provided herein. One of skill in the art will be able to identify the corresponding residue in any homologous protein, e.g., by sequence alignment and determination of homologous residues. Accordingly, one of skill in the art would be able to generate mutations in any naturally-occurring cytidine deaminase that corresponds to any of the mutations described herein. In some embodiments, the cytidine deaminase is from a prokaryote. In some embodiments, the cytidine deaminase is from a bacterium. In some embodiments, the cytidine deaminase is from a mammal (e.g., human).

In some embodiments, the cytidine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the cytidine deaminase amino acid sequences set forth herein. It should be appreciated that cytidine deaminases provided herein may include one or more mutations (e.g., any of the mutations provided herein). The disclosure provides any deaminase domains with a certain percent identity plus any of the mutations or combinations thereof described herein. In some embodiments, the cytidine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the cytidine deaminases provided herein. In some embodiments, the cytidine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

Additional Domains

A base editor described herein can include any domain which helps to facilitate the nucleobase editing, modification, or altering of a nucleobase of a polynucleotide. In some embodiments, a base editor comprises a polynucleotide programmable nucleotide binding domain (e.g., Cas9), a nucleobase editing domain (e.g., deaminase domain), and one or more additional domains. In some cases, the additional domain can facilitate enzymatic or catalytic functions of the base editor, binding functions of the base editor, or be inhibitors of cellular machinery (e.g., enzymes) that could interfere with the desired base editing result. In some embodiments, a base editor can comprise a nuclease, a nickase, a recombinase, a deaminase, a methyltransferase, a methylase, an acetylase, an acetyltransferase, a transcriptional activator, or a transcriptional repressor domain.

In some embodiments, a base editor can comprise a uracil glyocsylase inhibitor (UGI) domain. A UGI domain can, for example, improve the efficiency of base editors comprising a cytidine deaminase domain by inhibiting the conversion of a U formed by deamination of a C back to the C nucleobase. In some cases, cellular DNA repair response to the presence of U:G heteroduplex DNA can be responsible for a decrease in nucleobase editing efficiency in cells. In such cases, uracil DNA glyocsylase (UDG) can catalyze removal of U from DNA in cells, which can initiate base excision repair (BER), mostly resulting in reversion of the U:G pair to a C:G pair. In such cases, BER can be inhibited in base editors comprising one or more domains that bind the single strand, block the edited base, inhibit UGI, inhibit BER, protect the edited base, and/or promote repairing of the non-edited strand. Thus, this disclosure contemplates a base editor fusion protein comprising a UGI domain.

In some embodiments, a base editor comprises as a domain all or a portion of a double-strand break (DSB) binding protein. For example, a DSB binding protein can include a Gam protein of bacteriophage Mu that can bind to the ends of DSBs and can protect them from degradation. See Komor, A. C., et al., "Improved base excision repair inhibition and bacteriophage Mu Gam protein yields C:G-to-T:A base editors with higher efficiency and product purity" Science Advances 3:eaao4774 (2017), the entire content of which is hereby incorporated by reference.

In some embodiments, a base editor can comprise as a domain all or a portion of a nucleic acid polymerase (NAP). For example, a base editor can comprise all or a portion of a eukaryotic NAP. In some embodiments, a NAP or portion thereof incorporated into a base editor is a DNA polymerase. In some embodiments, a NAP or portion thereof incorporated into a base editor has translesion polymerase activity. In some cases, a NAP or portion thereof incorporated into a base editor is a translesion DNA polymerase. In some embodiments, a NAP or portion thereof incorporated into a base editor is a Rev7, Rev1 complex, polymerase iota, polymerase kappa, or polymerase eta. In some embodiments, a NAP or portion thereof incorporated into a base editor is a eukaryotic polymerase alpha, beta, gamma, delta, epsilon, gamma, eta, iota, kappa, lambda, mu, or nu component. In some embodiments, a NAP or portion thereof incorporated into a base editor comprises an amino acid sequence that is at least 75%, 80%, 85%, 90%, 95%, 96%, 97%, 98%, 99%, or 99.5% identical to a nucleic acid polymerase (e.g., a translesion DNA polymerase).

Base Editor System

Use of the base editor system provided herein comprises the steps of: (a) contacting a target nucleotide sequence of a polynucleotide (e.g., a double-stranded DNA or RNA, a single-stranded DNA or RNA) of a subject with a base editor system comprising a nucleobase editor (e.g., an adenosine base editor or a cytidine base editor) and a guide polynucleic acid (e.g., gRNA), wherein the target nucleotide sequence comprises a targeted nucleobase pair; (b) inducing strand separation of the target region; (c) converting a first nucleobase of the target nucleobase pair in a single strand of the target region to a second nucleobase; and (d) cutting no more than one strand of the target region, where a third nucleobase complementary to the first nucleobase base is replaced by a fourth nucleobase complementary to the second nucleobase. It should be appreciated that in some embodiments, step (b) is omitted. In some embodiments, the targeted nucleobase pair is a plurality of nucleobase pairs in one or more genes. In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more genes, wherein at least one gene is located in a different locus.

In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine.

Base editing system as provided herein provides a new approach to genome editing that uses a fusion protein containing a catalytically defective *Streptococcus pyogenes* Cas9, a cytidine deaminase, and an inhibitor of base excision repair to induce programmable, single nucleotide (C→T or A→G) changes in DNA without generating double-strand DNA breaks, without requiring a donor DNA template, and without inducing an excess of stochastic insertions and deletions.

Provided herein are systems, compositions, and methods for editing a nucleobase using a base editor system. In some embodiments, the base editor system comprises (1) a base editor (BE) comprising a polynucleotide programmable nucleotide binding domain and a nucleobase editing domain (e.g., a deaminase domain) for editing the nucleobase; and (2) a guide polynucleotide (e.g., guide RNA) in conjunction with the polynucleotide programmable nucleotide binding domain. In some embodiments, the base editor system comprises a cytosine base editor (CBE). In some embodiments, the base editor system comprises an adenosine base editor (ABE). In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the nucleobase editing domain is a deaminase domain. In some cases, a deaminase domain can be a cytosine deaminase or a cytidine deaminase. In some embodiments, the terms "cytosine deaminase" and "cytidine deaminase" can be used interchangeably. In some cases, a deaminase domain can be an adenine deaminase or an adenosine deaminase. In some embodiments, the terms "adenine deaminase" and "adenosine deaminase" can be used interchangeably. Details of nucleobase editing proteins are described in International PCT Application Nos. PCT/2017/045381 (WO2018/027078) and PCT/US2016/058344 (WO2017/070632), each of which is incorporated herein by reference in its entirety. Also see, Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

In some embodiments, the base editor inhibits base excision repair of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edit of base pair is upstream of a PAM site. In some embodiments, the intended edit of base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edit of base-pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site.

In some embodiments, the method does not require a canonical (e.g., NGG) PAM site. In some embodiments, the nucleobase editor comprises a linker or a spacer. In some embodiments, the linker or spacer is 1-25 amino acids in length. In some embodiments, the linker or spacer is 5-20 amino acids in length. In some embodiments, the linker or spacer is 10, 11, 12, 13, 14, 15, 16, 17, 18, 19, or 20 amino acids in length.

In some embodiments, the target region comprises a target window, wherein the target window comprises the target nucleobase pair. In some embodiments, the target window comprises 1-10 nucleotides. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edit of base pair is within the target window. In some embodiments, the target window comprises the intended edit of base pair. In some embodiments, the method is performed using any of the base editors provided herein. In some embodiments, a target window is a deamination window.

In some embodiments, the base editor is a cytidine base editor (CBE). In some embodiments, non-limiting exemplary CBE is BE1 (APOBEC1-XTEN-dCas9), BE2 (APOBEC1-XTEN-dCas9-UGI), BE3 (APOBEC1-XTEN-dCas9(A840H)-UGI), BE3-Gam, saBE3, saBE4-Gam, BE4, BE4-Gam, saBE4, or saB4E-Gam. BE4 extends the APOBEC1-Cas9n(D10A) linker to 32 amino acids and the Cas9n-UGI linker to 9 amino acids, and appends a second copy of UGI to the C terminus of the construct with another 9 amino acid linker into a single base editor construct. The base editors saBE3 and saBE4 have the S. pyogenes Cas9n (D10A) replaced with the smaller S. aureus Cas9n(D10A). BE3-Gam, saBE3-Gam, BE4-Gam, and saBE4-Gam have 174 residues of Gam protein fused to the N-terminus of BE3, saBE3, BE4, and saBE4 via the 16 amino acid XTEN linker.

In some embodiments, the base editor is an adenosine base editor (ABE). In some embodiments, the adenosine base editor can deaminate adenine in DNA. In some embodiments, the adenosine base editor can deaminate adenine in RNA. In some embodiments, ABE is generated by replacing APOBEC1 component of BE3 with natural or engineered E. coli TadA, human ADAR2, mouse ADA, or human ADAT2. In some embodiments, ABE comprises evolved TadA variant. In some embodiments, the ABE is ABE 1.2 (TadA*-XTEN-nCas9-NLS). In some embodiments, TadA* comprises A106V and D108N mutations.

In some embodiments, the ABE is a second generation ABE. In some embodiments, the ABE is ABE2.1, which comprises additional mutations D147Y and E155V in TadA* (TadA*2.1). In some embodiments, the ABE is ABE2.2, ABE2.1 fused to catalytically inactivated version of human alkyl adenine DNA glycosylase (AAG with E125Q mutation). In some embodiments, the ABE is ABE2.3, ABE2.1 fused to catalytically inactivated version of E. coli Endo V (inactivated with D35A mutation). In some embodiments, the ABE is ABE2.6 which has a linker twice as long (32 amino acids, $(SGGS)_2$-XTEN-$(SGGS)_2$ ("$(SGGS)_2$" disclosed as SEQ ID NO: 162)) as the linker in ABE2.1. In some embodiments, the ABE is ABE2.7, which is ABE2.1 tethered with an additional wild-type TadA monomer. In some embodiments, the ABE is ABE2.8, which is ABE2.1 tethered with an additional TadA*2.1 monomer. In some embodiments, the ABE is ABE2.9, which is a direct fusion of evolved TadA (TadA*2.1) to the N-terminus of ABE2.1. In some embodiments, the ABE is ABE2.10, which is a direct fusion of wild type TadA to the N-terminus of ABE2.1. In some embodiments, the ABE is ABE2.11, which is ABE2.9 with an inactivating E59A mutation at the N-terminus of TadA* monomer. In some embodiments, the ABE is ABE2.12, which is ABE2.9 with an inactivating E59A mutation in the internal TadA* monomer.

In some embodiments, the ABE is a third generation ABE. In some embodiments, the ABE is ABE3.1, which is ABE2.3 with three additional TadA mutations (L84F, H123Y, and I157F).

In some embodiments, the ABE is a fourth generation ABE. In some embodiments, the ABE is ABE4.3, which is ABE3.1 with an additional TadA mutation A142N (TadA*4.3).

In some embodiments, the ABE is a fifth generation ABE. In some embodiments, the ABE is ABE5.1, which is generated by importing a consensus set of mutations from surviving clones (H36L, R51L, S146C, and K157N) into ABE3.1. In some embodiments, the ABE is ABE5.3, which has a heterodimeric construct containing wild-type E. coli TadA fused to an internal evolved TadA*. In some embodiments, the ABE is ABE5.2, ABE5.4, ABE5.5, ABE5.6, ABE5.7, ABE5.8, ABE5.9, ABE5.10, ABE5.11, ABE5.12, ABE5.13, or ABE5.14, as shown in below Table 2. In some embodiments, the ABE is a sixth generation ABE. In some embodiments, the ABE is ABE6.1, ABE6.2, ABE6.3, ABE6.4, ABE6.5, or ABE6.6, as shown in below Table 2. In some embodiments, the ABE is a seventh generation ABE. In some embodiments, the ABE is ABE7.1, ABE7.2, ABE7.3, ABE7.4, ABE7.5, ABE7.6, ABE7.7, ABE7.8, ABE 7.9, or ABE7.10, as shown in below Table 2.

TABLE 2

Genotypes of ABEs

| | 23 | 26 | 36 | 37 | 48 | 49 | 51 | 72 | 84 | 87 | 105 | 108 | 123 | 125 | 142 | 145 | 147 | 152 | 155 | 156 | 157 | 16 |
|---|---|---|---|---|---|---|---|---|---|---|---|---|---|---|---|---|---|---|---|---|---|---|
| ABE0.1 | W | R | H | N | P | | R | N | L | S | A | D | H | G | A | S | D | R | E | I | K | K |
| ABE0.2 | W | R | H | N | P | | R | N | L | S | A | D | H | G | A | S | D | R | E | I | K | K |
| ABE1.1 | W | R | H | N | P | | R | N | L | S | A | N | H | G | A | S | D | R | E | I | K | K |
| ABE1.2 | W | R | H | N | P | | R | N | L | S | V | N | H | G | A | S | D | R | E | I | K | K |
| ABE2.1 | W | R | H | N | P | | R | N | L | S | V | N | H | G | A | S | Y | R | V | I | K | K |
| ABE2.2 | W | R | H | N | P | | R | N | L | S | V | N | H | G | A | S | Y | R | V | I | K | K |
| ABE2.3 | W | R | H | N | P | | R | N | L | S | V | N | H | G | A | S | Y | R | V | I | K | K |
| ABE2.4 | W | R | H | N | P | | R | N | L | S | V | N | H | G | A | S | Y | R | V | I | K | K |
| ABE2.5 | W | R | H | N | P | | R | N | L | S | V | N | H | G | A | S | Y | R | V | I | K | K |
| ABE2.6 | W | R | H | N | P | | R | N | L | S | V | N | H | G | A | S | Y | R | V | I | K | K |
| ABE2.7 | W | R | H | N | P | | R | N | L | S | V | N | H | G | A | S | Y | R | V | I | K | K |
| ABE2.8 | W | R | H | N | P | | R | N | L | S | V | N | H | G | A | S | Y | R | V | I | K | K |
| ABE2.9 | W | R | H | N | P | | R | N | L | S | V | N | H | G | A | S | Y | R | V | I | K | K |
| ABE2.10 | W | R | H | N | P | | R | N | L | S | V | N | H | G | A | S | Y | R | V | I | K | K |
| ABE2.11 | W | R | H | N | P | | R | N | L | S | V | N | H | G | A | S | Y | R | V | I | K | K |
| ABE2.12 | W | R | H | N | P | | R | N | L | S | V | N | H | G | A | S | Y | R | V | I | K | K |
| ABE3.1 | W | R | H | N | P | | R | N | F | S | V | N | Y | G | A | S | Y | R | V | F | K | K |
| ABE3.2 | W | R | H | N | P | | R | N | F | S | V | N | Y | G | A | S | Y | R | V | F | K | K |
| ABE3.3 | W | R | H | N | P | | R | N | F | S | V | N | Y | G | A | S | Y | R | V | F | K | K |
| ABE3.4 | W | R | H | N | P | | R | N | F | S | V | N | Y | G | A | S | Y | R | V | F | K | K |
| ABE3.5 | W | R | H | N | P | | R | N | F | S | V | N | Y | G | A | S | Y | R | V | F | K | K |
| ABE3.6 | W | R | H | N | P | | R | N | F | S | V | N | Y | G | A | S | Y | R | V | F | K | K |
| ABE3.7 | W | R | H | N | P | | R | N | F | S | V | N | Y | G | A | S | Y | R | V | F | K | K |
| ABE3.8 | W | R | H | N | P | | R | N | F | S | V | N | Y | G | A | S | Y | R | V | F | K | K |
| ABE4.1 | W | R | H | N | P | | R | N | L | S | V | N | H | G | N | S | Y | R | V | I | K | K |
| ABE4.2 | W | G | H | N | P | | R | N | L | S | V | N | H | G | N | S | Y | R | V | I | K | K |
| ABE4.3 | W | R | H | N | P | | R | N | F | S | V | N | Y | G | N | S | Y | R | V | F | K | K |
| ABE5.1 | W | R | L | N | P | | L | N | F | S | V | N | Y | G | A | C | Y | R | V | F | N | K |
| ABE5.2 | W | R | H | S | P | | R | N | F | S | V | N | Y | G | A | S | Y | R | V | F | K | T |
| ABE5.3 | W | R | L | N | P | | L | N | I | S | V | N | Y | G | A | C | Y | R | V | I | N | K |
| ABE5.4 | W | R | H | S | P | | R | N | F | S | V | N | Y | G | A | S | Y | R | V | F | K | T |
| ABE5.5 | W | R | L | N | P | | L | N | F | S | V | N | Y | G | A | C | Y | R | V | F | N | K |
| ABE5.6 | W | R | L | N | P | | L | N | F | S | V | N | Y | G | A | C | Y | R | V | F | N | K |
| ABE5.7 | W | R | L | N | P | | L | N | F | S | V | N | Y | G | A | C | Y | R | V | F | N | K |
| ABE5.8 | W | R | L | N | P | | L | N | F | S | V | N | Y | G | A | C | Y | R | V | F | N | K |
| ABE5.9 | W | R | L | N | P | | L | N | F | S | V | N | Y | G | A | C | Y | R | V | F | N | K |
| ABE5.10 | W | R | L | N | P | | L | N | F | S | V | N | Y | G | A | C | Y | R | V | F | N | K |
| ABE5.11 | W | R | L | N | P | | L | N | F | S | V | N | Y | G | A | C | Y | R | V | F | N | K |
| ABE5.12 | W | R | L | N | P | | L | N | F | S | V | N | Y | G | A | C | Y | R | V | F | N | K |
| ABE5.13 | W | R | H | N | P | | L | D | F | S | V | N | Y | A | A | S | Y | R | V | F | K | K |
| ABE5.14 | W | R | H | N | S | | L | N | F | C | V | N | Y | G | A | S | Y | R | V | F | K | K |
| ABE6.1 | W | R | H | N | S | | L | N | F | S | V | N | Y | G | N | S | Y | R | V | F | K | K |
| ABE6.2 | W | R | H | N | T | V | L | N | F | S | V | N | Y | G | N | S | Y | R | V | F | N | K |
| ABE6.3 | W | R | L | N | S | | L | N | F | S | V | N | Y | G | A | C | Y | R | V | F | N | K |
| ABE6.4 | W | R | L | N | S | | L | N | F | S | V | N | Y | G | N | C | Y | R | V | F | N | K |
| ABE6.5 | W | R | L | N | I | V | L | N | F | S | V | N | Y | G | A | C | Y | R | V | F | N | K |
| ABE6.6 | W | R | L | N | T | V | L | N | F | S | V | N | Y | G | N | C | Y | R | V | F | N | K |
| ABE7.1 | W | R | L | N | A | | L | N | F | S | V | N | Y | G | A | C | Y | R | V | F | N | K |
| ABE7.2 | W | R | L | N | A | | L | N | F | S | V | N | Y | G | N | C | Y | R | V | F | N | K |
| ABE7.3 | I | R | L | N | A | | L | N | F | S | V | N | Y | G | A | C | Y | R | V | F | N | K |
| ABE7.4 | R | R | L | N | A | | L | N | F | S | V | N | Y | G | A | C | Y | R | V | F | N | K |
| ABE7.5 | W | R | L | N | A | | L | N | F | S | V | N | Y | G | A | C | Y | H | V | F | N | K |
| ABE7.6 | W | R | L | N | A | | L | N | I | S | V | N | Y | G | A | C | Y | P | V | I | N | K |
| ABE7.7 | L | R | L | N | A | | L | N | F | S | V | N | Y | G | A | C | Y | P | V | F | N | K |
| ABE7.8 | I | R | L | N | A | | L | N | F | S | V | N | Y | G | N | C | Y | R | V | F | N | K |
| ABE7.9 | L | R | L | N | A | | L | N | F | S | V | N | Y | G | A | C | Y | P | V | F | N | K |
| ABE7.10 | R | R | L | N | A | | L | N | F | S | V | N | Y | G | A | C | Y | P | V | F | N | K |

In some embodiments, the base editor comprises a polynucleotide programmable DNA binding domain and a cytidine deaminase domain for deaminating a cytidine nucleobase, wherein a guide polynucleotide targets the base editor to the target nucleotide sequence located in a coding region of agene, such as a gene associated with a pathogenic mutation, for example, ACADM, HBB, PDS, SNCA, or SERPINA1, or in a regulatory region of agene, such as a gene listed in Table 4 herein.

In some embodiments, the base editor is a fusion protein comprising a polynucleotide programmable nucleotide binding domain (e.g., Cas9-derived domain) fused to a nucleobase editing domain (e.g., all or a portion of a deaminase domain). In some embodiments, the base editor further comprises a domain comprising all or a portion of a uracil glycosylase inhibitor (UGI). In some embodiments, the base editor comprises a domain comprising all or a portion of a uracil binding protein (UBP), such as a uracil DNA glycosylase (UDG). In some embodiments, the base editor comprises a domain comprising all or a portion of a nucleic acid polymerase. In some embodiments, a nucleic acid polymerase or portion thereof incorporated into a base editor is a translesion DNA polymerase.

In some embodiments, a domain of the base editor can comprise multiple domains. For example, the base editor comprising a polynucleotide programmable nucleotide binding domain derived from Cas9 can comprise an REC lobe and an NUC lobe corresponding to the REC lobe and NUC lobe of a wild-type or natural Cas9. In another example, the base editor can comprise one or more of a RuvCI domain, BH domain, REC1 domain, REC2 domain, RuvCII domain, L1 domain, HNH domain, L2 domain, RuvCIII domain, WED domain, TOPO domain or CTD domain. In some embodiments, one or more domains of the base editor comprise a mutation (e.g., substitution, insertion, deletion) relative to a wild type version of a polypeptide comprising the domain. For example, an HNH domain of a polynucleotide programmable DNA binding domain can comprise an H840A substitution. In another example, a RuvCI domain of a polynucleotide programmable DNA binding domain can comprise a D10A substitution.

Different domains (e.g. adjacent domains) of the base editor disclosed herein can be connected to each other with or without the use of one or more linker domains (e.g. an XTEN linker domain). In some cases, a linker domain can be a bond (e.g., covalent bond), chemical group, or a molecule linking two molecules or moieties, e.g., two domains of a fusion protein, such as, for example, a first domain (e.g., Cas9-derived domain) and a second domain (e.g., a cytidine deaminase domain or adenosine deaminase domain). In some embodiments, a linker is a covalent bond (e.g., a carbon-carbon bond, disulfide bond, carbon-hetero atom bond, etc.). In certain embodiments, a linker is a carbon nitrogen bond of an amide linkage. In certain embodiments, a linker is a cyclic or acyclic, substituted or unsubstituted, branched or unbranched aliphatic or heteroaliphatic linker. In certain embodiments, a linker is polymeric (e.g., polyethylene, polyethylene glycol, polyamide, polyester, etc.). In certain embodiments, a linker comprises a monomer, dimer, or polymer of aminoalkanoic acid. In some embodiments, a linker comprises an aminoalkanoic acid (e.g., glycine, ethanoic acid, alanine, beta-alanine, 3-aminopropanoic acid, 4-aminobutanoic acid, 5-pentanoic acid, etc.). In some embodiments, a linker comprises a monomer, dimer, or polymer of aminohexanoic acid (Ahx). In certain embodiments, a linker is based on a carbocyclic moiety (e.g., cyclopentane, cyclohexane). In other embodiments, a linker comprises a polyethylene glycol moiety (PEG). In certain embodiments, a linker comprises an aryl or heteroaryl moiety. In certain embodiments, the linker is based on a phenyl ring. A linker can include functionalized moieties to facilitate attachment of a nucleophile (e.g., thiol, amino) from the peptide to the linker. Any electrophile can be used as part of the linker. Exemplary electrophiles include, but are not limited to, activated esters, activated amides, Michael acceptors, alkyl halides, aryl halides, acyl halides, and isothiocyanates. In some embodiments, a linker joins a gRNA binding domain of an RNA-programmable nuclease, including a Cas9 nuclease domain, and the catalytic domain of a nucleic acid editing protein. In some embodiments, a linker joins a dCas9 and a second domain (e.g., cytidine deaminase, UGI, etc.).

Typically, a linker is positioned between, or flanked by, two groups, molecules, or other moieties and connected to each one via a covalent bond, thus connecting the two. Typically, a linker is, thus connecting the two. In some embodiments, a linker is an amino acid or a plurality of amino acids (e.g., a peptide or protein). In some embodiments, a linker is an organic molecule, group, polymer, or chemical moiety. In some embodiments, a linker is 2-100 amino acids in length, for example, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length. Longer or shorter linkers are also contemplated. In some embodiments, a linker domain comprises the amino acid sequence SGSETPGTSESATPES (SEQ ID NO: 48), which can also be referred to as the XTEN linker. Any method for linking the fusion protein domains can be employed (e.g., ranging from very flexible linkers of the form form (SGGS)n (SEQ ID NO: 49), (GGGS)n (SEQ ID NO: 163), (GGGGS)n (SEQ ID NO: 164), and (G)n, to more rigid linkers of the form (EAAAK)n (SEQ ID NO: 165), (GGS)n, SGSETPGT-SESATPES (SEQ ID NO: 48) (see, e.g., Guilinger J P, Thompson D B, Liu D R Fusion of catalytically inactive Cas9 to FokI nuclease improves the specificity of genome modification. Nat. Biotechnol. 2014; 32(6): 577-82; the entire contents are incorporated herein by reference), or $(XP)_n$ motif, in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a $(GGS)_n$ motif (SEQ ID NO: 166), wherein n is 1, 3, or 7. In some embodiments, the Cas9 domain of the fusion proteins provided herein are fused via a linker comprising the amino acid sequence SGSETPGTSESATPES (SEQ ID NO: 48). In some embodiments, a linker comprises a plurality of proline residues and is 5-21, 5-14, 5-9, 5-7 amino acids in length, e.g., PAPAP (SEQ ID NO: 57), PAPAPA (SEQ ID NO: 58), PAPAPAP (SEQ ID NO: 59), PAPAPAPA (SEQ ID NO: 60), $P(AP)_4$ (SEQ ID NO: 61), $P(AP)_7$ (SEQ ID NO: 62), $P(AP)_{10}$ (SEQ ID NO: 63) (see, e.g., Tan J, Zhang F, Karcher D, Bock R Engineering of high-precision base editors for site-specific single nucleotide replacement. Nat Commun. 2019 Jan. 25; 10(1):439; the entire contents are incorporated herein by reference). Such proline-rich linkers are also termed "rigid" linkers.

A fusion protein of the invention comprises a nucleic acid editing domain. In some embodiments, the nucleic acid editing domain can catalyze a C to U base change. In some embodiments, the nucleic acid editing domain is a deaminase domain. In some embodiments, the deaminase is a cytidine deaminase or an adenosine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3 A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase, e.g., rAPOBEC1. In some embodiments, the deaminase is a *Petromyzon marinus* cytidine deaminase 1 (pmCDA1). In some embodiments, the deaminase is a human APOBEC3G. In some embodiments, the deaminase is a fragment of the human APOBEC3G. In some embodiments, the deaminase is a human APOBEC3G variant comprising a D316R D317R mutation. In some embodiments, the deaminase is a fragment of the human APOBEC3G and comprising mutations corresponding to the D316R D317R mutations. In some embodiments, the nucleic acid editing domain is at least 80%, at least 85%, at least 90%, at least 92%, at least 95%, at least 96%, at least 97%, at least 98%, at least 99%), or at least 99.5% identical to the deaminase domain of any deaminase described herein.

Cas9 Complexes with Guide RNAs

Some aspects of this disclosure provide complexes comprising any of the fusion proteins provided herein, and a guide RNA (e.g., a guide that targets a gene of interest, such as a gene set forth in Tables 3A and 3B, or a regulatory sequence of a gene set forth in Table 4).

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence (NGG). In some embodiments, the 3' end of the target sequence is immediately adjacent to a non-canonical PAM sequence (e.g., a sequence listed in Tables 3A or 3B or 5'-NAA-3'). In some embodiments, the guide nucleic acid (e.g., guide RNA) is complementary to a sequence in gene bearing disease targetable mutations.

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to an AGC, GAG, TTT, GTG, or CAA sequence. In some embodiments, the 3' end of the target sequence is immediately adjacent to an NGA, NAA, NGCG, NGN, NNGRRT, NNNRRT, NGCG, NGCN, NGTN, NGTN, NGTN, or 5' (TTTV) sequence.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for Cas9 binding, and a guide sequence, which confers sequence specificity to the Cas9: nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

The domains of the base editor disclosed herein can be arranged in any order. Non-limiting examples of a base editor comprising a fusion protein comprising, e.g., a polynucleotide-programmable nucleotide-binding domain and a deaminase domain, can be arranged as follows:

NH$_2$-[nucleobase editing domain]-Linker1-[e.g., Cas9 derived domain]-COOH;

NH$_2$-[e.g., cytidine deaminase]-Linker1-[e.g., Cas9 derived domain]-COOH;

NH$_2$-[e.g., cytidine deaminase]-Linker1-[e.g., Cas9 derived domain]-Linker2-[UGI]-COOH;

NH$_2$-[e.g., APOBEC]-Linker1-[e.g., Cas9 derived domain]-COOH;

NH$_2$-[e.g., cytidine deaminase]-Linker1-[e.g., Cas9 derived domain]-COOH;

NH$_2$-[e.g., APOBEC]-Linker1-[e.g., Cas9 derived domain]-COOH;

NH$_2$-[e.g., APOBEC]-Linker1-[e.g., Cas9 derived domain]-Linker2-[UGI]-COOH

NH$_2$-[e.g., adenosine deaminase]-[e.g., Cas9 derived domain]-COOH;

NH$_2$-[e.g., Cas9 derived domain]-[e.g., adenosine deaminase]-COOH;

NH$_2$-[e.g., adenosine deaminase]-[e.g., Cas9 derived domain]-[inosine BER inhibitor]-COOH;

NH$_2$-[e.g., adenosine deaminase]-[inosine BER inhibitor]-[e.g., Cas9 derived domain]-COOH;

NH$_2$-[inosine BER inhibitor]-[e.g., adenosine deaminase]-[e.g., Cas9 derived domain]-COOH;

NH$_2$-[e.g., Cas9 derived domain]-[e.g., adenosine deaminase]-[inosine BER inhibitor]-COOH;

NH$_2$-[e.g., Cas9 derived domain]-[inosine BER inhibitor]-[e.g., adenosine deaminase]-COOH; or NH$_2$-[inosine BER inhibitor]-[e.g., Cas9 derived domain]-[e.g., adenosine deaminase]-COOH.

In addition, in some cases, a Gam protein can be fused to an N terminus of a base editor. In some cases, a Gam protein can be fused to a C terminus of a base editor. The Gam protein of bacteriophage Mu can bind to the ends of double strand breaks (DSBs) and protect them from degradation. In some embodiments, using Gam to bind the free ends of DSB can reduce indel formation during the process of base editing. In some embodiments, a 174-residue Gam protein is fused to the N terminus of the base editors. See, e.g., Komor, A. C., et al., "Improved base excision repair inhibition and bacteriophage Mu Gam protein yields C:G-to-T:A base editors with higher efficiency and product purity" Science Advances 3:eaao4774 (2017). In some cases, a mutation or mutations can change the length of a base editor domain relative to a wild type domain. For example, a deletion of at least one amino acid in at least one domain can reduce the length of the base editor. In another case, a mutation or mutations do not change the length of a domain relative to a wild type domain. For example, substitution(s) in any domain does/do not change the length of the base editor. Non-limiting examples of such base editors, where the length of all the domains is the same as the wild type domains, can include:

NH$_2$-[APOBEC1]-Linker1-[Cas9(D10A)]-Linker2-[UGI]-COOH;

NH$_2$-[CDA1]-Linker1-[Cas9(D10A)]-Linker2-[UGI]-COOH;

NH$_2$-[AID]-Linker1-[Cas9(D10A)]-Linker2-[UGI]-COOH;

NH$_2$-[APOBEC1]-Linker1-[Cas9(D10A)]-Linker2-[SSB]-COOH;

NH$_2$-[UGI]-Linker1-[ABOBEC1]-Linker2-[Cas9(D10A)]-COOH;

NH$_2$-[APOBEC1]-Linker1-[Cas9(D10A)]-Linker2-[UGI]-Linker3-[UGI]-COOH;

NH$_2$-[Cas9(D10A)]-Linker1-[CDA1]-Linker2-[UGI]-COOH;

NH$_2$-[Gam]-Linker1-[APOBEC1]-Linker2-[Cas9(D10A)]-Linker3-[UGI]-COOH;

NH$_2$-[Gam]-Linker1-[APOBEC1]-Linker2-[Cas9(D10A)]-Linker3-[UGI]-Linker4-[UGI]-COOH;

NH2-[APOBEC1]-Linker1-[dCas9(D10A, H840A)]-Linker2-[UGI]-COOH; or

NH2-[APOBEC1]-Linker1-[dCas9(D10A, H840A)]-COOH.

In some embodiments, the base editing fusion proteins provided herein need to be positioned at a precise location, for example, where a target base is placed within a defined region (e.g., a "deamination window"). In some cases, a target can be within a 4-base region. In some cases, such a defined target region can be approximately 15 bases upstream of the PAM. See, e.g., Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

A defined target region can be a deamination window. A deamination window can be the defined region in which a base editor acts upon and deaminates a target nucleotide. In some embodiments, the deamination window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facilitates the editing of a target polynucleotide sequence. For example, in some embodiments, the base editor comprises a nuclear localization sequence (NLS). In some embodiments, an NLS of the base editor is localized between a deaminase domain and a polynucleotide programmable nucleotide binding domain. In some embodiments, an NLS of the base editor is localized C-terminal to a polynucleotide programmable nucleotide binding domain.

Other exemplary features that can be present in a base editor as disclosed herein are localization sequences, such as cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Non-limiting examples of protein domains which can be included in the fusion protein include a deaminase domain (e.g., cytidine deaminase and/or adenosine deaminase), a uracil glycosylase inhibitor (UGI) domain, epitope tags, reporter gene sequences, and/or protein domains having one or more of the following activities: methylase activity, demethylase activity, transcription activation activity, transcription repression activity, transcription release factor activity, histone modification activity, RNA cleavage activity, and nucleic acid binding activity. Additional domains can be a heterologous functional domain. Such heterologous functional domains can confer a function activity, such as DNA methylation, DNA damage, DNA repair, modification of a target polypeptide associated with target DNA (e.g., a histone, a DNA-binding protein, etc.), leading to, for example, histone methylation, histone acetylation, histone ubiquitination, and the like.

Other functions conferred can include methyltransferase activity, demethylase activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, remodelling activity, protease activity, oxidoreductase activity, transferase activity, hydrolase activity, lyase activity, isomerase activity, synthase activity, synthetase activity, and demyristoylation activity, or any combination thereof.

Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). Additional protein sequences can include amino acid sequences that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions.

Base Editor Efficiency

CRISPR-Cas9 nucleases have been widely used to mediate targeted genome editing. In most genome editing applications, Cas9 forms a complex with a guide polynucleotide (e.g., single guide RNA (sgRNA)) and induces a double-stranded DNA break (DSB) at the target site specified by the sgRNA sequence. Cells primarily respond to this DSB through the non-homologuous end-joining (NHEJ) repair pathway, which results in stochastic insertions or deletions (indels) that can cause frameshift mutations that disrupt the gene. In the presence of a donor DNA template with a high degree of homology to the sequences flanking the DSB, gene correction can be achieved through an alternative pathway known as homology directed repair (HDR). Unfortunately, under most non-perturbative conditions HDR is inefficient, dependent on cell state and cell type, and dominated by a larger frequency of indels. As most of the known genetic variations associated with human disease are point mutations, methods that can more efficiently and cleanly make precise point mutations are needed. Base editing system as provided herein provides a new way to edit genome editing without generating double-strand DNA breaks, without requiring a donor DNA template, and without inducing an excess of stochastic insertions and deletions.

The base editors provided herein are capable of modifying a specific nucleotide base without generating a significant proportion of indels. The term "indel(s)", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g., mutate or deaminate) a specific nucleotide within a nucleic acid, without generating a large number of insertions or deletions (i.e., indels) in the target nucleotide sequence. In certain embodiments, any of the base editors provided herein are capable of generating a greater proportion of intended modifications (e.g., point mutations or deaminations) versus indels.

In some embodiments, any of base editor systems provided herein results in less than 50%, less than 40%, less than 30%, less than 20%, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% indel formation in the target polynucleotide sequence.

Some aspects of the disclosure are based on the recognition that any of the base editors provided herein are capable of efficiently generating an intended mutation, such as a point mutation, in a nucleic acid (e.g. a nucleic acid within a genome of a subject) without generating a significant number of unintended mutations, such as unintended point mutations.

In some embodiments, any of the base editors provided herein are capable of generating at least 0.01% of intended mutations (i.e. at least 0.01% base editing efficiency). In some embodiments, any of the base editors provided herein are capable of generating at least 0.01%, 1%, 2%, 3%, 4%, 5%, 10%, 15%, 20%, 25%, 30%, 40%, 45%, 50%, 60%, 70%, 80%, 90%, 95%, or 99% of intended mutations.

In some embodiments, the base editors provided herein are capable of generating a ratio of intended point mutations to indels that is greater than 1:1. In some embodiments, the base editors provided herein are capable of generating a ratio of intended point mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 8.5:1, at least 9:1, at least 10:1, at least 11:1, at least 12:1, at least 13:1, at least 14:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more.

The number of intended mutations and indels can be determined using any suitable method, for example, as described in International PCT Application Nos. PCT/2017/045381 (WO2018/027078) and PCT/US2016/058344 (WO2017/070632); Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity," Science Advances 3:eaao4774 (2017); the entire contents of which are hereby incorporated by reference.

In some embodiments, to calculate indel frequencies, sequencing reads are scanned for exact matches to two 10-bp sequences that flank both sides of a window in which indels can occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively. In some embodiments, the base editors provided herein can limit formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor.

The number of indels formed at a target nucleotide region can depend on the amount of time a nucleic acid (e.g., a nucleic acid within the genome of a cell) is exposed to a base editor. In some embodiments, the number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing the target nucleotide sequence (e.g., a nucleic acid within the genome of a cell) to a base editor. It should be appreciated that the characteristics of the base editors as described herein can be applied to any of the fusion proteins, or methods of using the fusion proteins provided herein.

Multiplex Editing

In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more gene, wherein at least one gene is located in a different locus. In some embodiments, the multiplex editing can comprise one or more guide polynucleotides. In some embodiments, the multiplex editing can comprise one or more base editor system. In some embodiments, the multiplex editing can comprise one or more base editor systems with a single guide polynucleotide. In some embodiments, the multiplex editing can comprise one or more base editor system with a plurality of guide polynucleotides. In some embodiments, the multiplex editing can comprise one or more guide polynucleotide with a single base editor system. In some embodiments, the multiplex editing can comprise at least one guide polynucleotide that does not require a PAM sequence to target binding to a target polynucleotide sequence. In some embodiments, the multiplex editing can comprise at least one guide polynucleotide that require a PAM sequence to target binding to a target polynucleotide sequence. In some embodiments, the multiplex editing can comprise a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of multiplex editing using any of the base editors as described herein can be applied to any of combination of the methods of using any of the base editors provided herein. It should also be appreciated that the multiplex editing using any of the base editors as described herein can comprise a sequential editing of a plurality of nucleobase pairs.

The methods provided herein comprises the steps of: (a) contacting a target nucleotide sequence of a polynucleotide of a subject (e.g., a double-stranded DNA sequence) with a base editor system comprising a nucleobase editor (e.g., an adenosine base editor or a cytidine base editor) and a guide polynucleic acid (e.g., gRNA), wherein the target nucleotide sequence comprises a targeted nucleobase pair; (b) inducing strand separation of the target region; (c) editing a first nucleobase of the target nucleobase pair in a single strand of the target region to a second nucleobase; and (d) cutting no more than one strand of the target region, where a third nucleobase complementary to the first nucleobase base is replaced by a fourth nucleobase complementary to the second nucleobase.

In some embodiments, the plurality of nucleobase pairs is in one more genes. In some embodiments, the plurality of nucleobase pairs is in the same gene. In some embodiments, at least one gene in the one more genes is located in a different locus.

In some embodiments, the base editing involves editing of the plurality of nucleobase pairs in at least one protein coding region. In some embodiments, the base editing involves editing of the plurality of nucleobase pairs in at least one protein non-coding region. In some embodiments the base editing involves editing of the plurality of nucleobase pairs in at least one protein coding region and at least one protein non-coding region.

In some embodiments, the editing is in conjunction with one or more guide polynucleotides. In some embodiments, the base editor system can comprise one or more base editor system. In some embodiments, the base editor system can comprise one or more base editor systems in conjunction with a single guide polynucleotide. In some embodiments, the base editor system can comprise one or more base editor system in conjunction with a plurality of guide polynucleotides. In some embodiments, the editing is in conjunction with one or more guide polynucleotide with a single base editor system. In some embodiments, the editing is in conjunction with at least one guide polynucleotide that does not require a PAM sequence to target binding to a target polynucleotide sequence. In some embodiments, the editing is in conjunction with at least one guide polynucleotide that require a PAM sequence to target binding to a target polynucleotide sequence. In some embodiments, the editing is in conjunction with a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editors provided herein. It should also be appreciated that the editing can comprise a sequential editing of a plurality of nucleobase pairs.

Methods of Using Base Editors

The correction of point mutations in disease-associated genes and alleles offers and provides new strategies for gene correction with applications in therapeutics and basic research.

The present disclosure provides methods for the treatment of a subject diagnosed with a disease associated with or caused by a point mutation that can be corrected by a base editor system provided herein. For example, in some embodiments, a method is provided that comprises administering to a subject having such a disease, e.g., a disease caused by a genetic mutation, an effective amount of a nucleobase editor (e.g., an adenosine deaminase base editor or a cytidine deaminase base editor) that substitutes a pathogenic amino acid to a benign amino acid that alleviates the disease phenotype. In various embodiments, the disease is a proliferative disease, a genetic disease, a neoplastic disease, or a metabolic disease. Non-limiting examples of such diseases and disorders include a hemoglobin disease or disorder, sickle cell disease, beta-thalassemia, alpha-1 antitrypsin deficiency (A1AD), hepatic *porphyria*, ACADM deficiency, Pendred syndrome, or familial Parkinson's disease. By way of a non-limiting example, a method is provided that comprises administering to a subject having sickle cell disease an effective amount of an A-to-G nucleobase editor (e.g., an adenosine deaminase base editor) that substitutes a pathogenic amino acid (Val) for a benign amino acid (Ala) that alleviates the sickle cell disease phenotype.

Other diseases that can be treated by correcting a point mutation or introducing a deactivating mutation into a disease-associated gene are known to those of skill in the art, and the disclosure is not limited in this respect. The present disclosure provides methods for the treatment of additional diseases or disorders, e.g., diseases or disorders that are associated or caused by a point mutation that can be corrected by deaminase mediated gene editing. Some such diseases are described herein, and additional suitable diseases that can be treated with the strategies and fusion proteins provided herein will be apparent to those of skill in the art based on the instant disclosure. It will be appreciated that the numbering of the specific positions or residues in the respective sequences depends on the particular protein and numbering scheme used. Numbering can be different, e.g., in precursors of a mature protein and the mature protein itself, and differences in sequences from species to species can affect numbering. One having skill in the art is able to identify the respective residue in any homologous protein and in the respective encoding nucleic acid sequence by methods well known in the art, e.g., by sequence alignment and determination of homologous residues.

Provided herein are methods of using the base editor or base editor system for editing a nucleobase in a target nucleotide sequence associated with a disease or disorder. In some embodiments, the activity of the base editor (e.g., comprising an adenosine deaminase and a Cas9 domain) results in a correction of the point mutation. In some embodiments, the target DNA sequence comprises a G→A point mutation associated with a disease or disorder, and wherein the deamination of the mutant A base results in a sequence that is not associated with a disease or disorder. In some embodiments, the target DNA sequence comprises a T-C point mutation associated with a disease or disorder, and wherein the deamination of the mutant C base results in a sequence that is not associated with a disease or disorder.

In some embodiments, the target DNA sequence encodes a protein, and the point mutation is in a codon and results in a change in the amino acid encoded by the mutant codon as compared to the wild-type codon. In some embodiments, the deamination of the mutant A results in a change of the amino acid encoded by the mutant codon. In some embodiments, the deamination of the mutant A results in the codon encoding the wild-type amino acid. In some embodiments, the deamination of the mutant C results in a change of the amino acid encoded by the mutant codon. In some embodiments, the deamination of the mutant C results in the codon encoding the wild-type amino acid. In some embodiments, the subject has or has been diagnosed with a disease or disorder.

In some embodiments, the adenosine deaminases provided herein are capable of deaminating adenine of a deoxyadenosine residue of DNA. Other aspects of the disclosure provide fusion proteins that comprise an adenosine deaminase (e.g., an adenosine deaminase that deaminates deoxyadenosine in DNA as described herein) and a domain (e.g., a Cas9 or a Cpf1 protein) capable of binding to a specific nucleotide sequence. For example, the adenosine can be converted to an inosine residue, which typically base pairs with a cytosine residue. Such fusion proteins are useful inter alia for targeted editing of nucleic acid sequences. Such fusion proteins can be used for targeted editing of DNA in vitro, e.g., for the generation of mutant cells or animals; for the introduction of targeted mutations, e.g., for the correction of genetic defects in cells ex vivo, e.g., in cells obtained from a subject that are subsequently re-introduced into the same or another subject; and for the introduction of targeted mutations in vivo, e.g., the correction of genetic defects or the introduction of deactivating mutations in disease-associated genes in a G to A, or a T to C to mutation can be treated using the nucleobase editors provided herein. The present disclosure provides deaminases, fusion proteins, nucleic acids, vectors, cells, compositions, methods, kits, systems, etc. that utilize the deaminases and nucleobase editors.

Use of Nucleobase Editors to Target Nucleotides in a Regulatory Region of HBG1/2

The suitability of nucleobase editors that target a nucleotide in a regulatory region of HBG1/2 genes is evaluated as described herein. In one embodiment, a single cell of interest is transfected, transduced, or otherwise modified with a nucleic acid molecule or molecules encoding a nucleobase editor described herein together with a small amount of a vector encoding a reporter (e.g., GFP). These cells can be immortalized human cell lines, such as 293T cells, K562 cells, or U20S cells. Alternatively, primary human cells may be used, e.g., CD34+ cells. Cells may also be obtained from a subject or individual, such as from tissue biopsy, surgery, blood, plasma, serum, or other biological fluid. Such cells may be relevant to the eventual cell target.

Delivery may be performed using a viral vector as further described below. In one embodiment, transfection may be performed using lipid transfection (such as Lipofectamine or Fugene) or by electroporation. Following transfection, expression of GFP can be determined either by fluorescence microscopy or by flow cytometry to confirm consistent and high levels of transfection. These preliminary transfections can comprise different nucleobase editors to determine which combinations of editors give the greatest activity.

The activity of the nucleobase editor is assessed as described herein, i.e., by sequencing the target gene to detect alterations in the target sequence. For Sanger sequencing, purified PCR amplicons are cloned into a plasmid backbone, transformed, miniprepped and sequenced with a single primer. Sequencing may also be performed using next generation sequencing techniques. When using next generation sequencing, amplicons may be 300-500 bp with the intended cut site placed asymmetrically. Following PCR, next generation sequencing adapters and barcodes (for example, Illumina multiplex adapters and indexes) may be added to the ends of the amplicon, e.g., for use in high throughput sequencing (for example on an Illumina MiSeq).

The fusion proteins that induce the greatest levels of target specific alterations in initial tests can be selected for further evaluation.

In particular embodiments, the nucleobase editors are used to target polynucleotides of interest. In one embodiment, a nucleobase editor of the invention is delivered to the appropriate cells (e.g., liver cells, hematopoietic cells such as CD34+ cells, or progenitors thereof) in conjunction with a guide RNA that is used to target a nucleic acid sequence, e.g., a target nucleic acid sequence of a regulatory region associated with the HBG1/2 genes, thereby correcting or reducing abnormal or aberrant function or activity of the genes.

In some embodiments, a base editor is targeted by a guide RNA to introduce one or more edits to the regulatory sequence of interest. In some embodiments, the one or more alterations introduced into the Mecp2 gene are as presented in Table 4 infra.

Generating an Intended Mutation

In some embodiments, the purpose of the methods provided herein is to restore the function of a dysfunctional gene via gene editing. In some embodiments, the function of a dysfunctional gene is restored by introducing an intended mutation. The nucleobase editing proteins provided herein can be validated for gene editing-based human therapeutics in vitro, e.g., by correcting a disease-associated mutation in human cell culture. It will be understood by the skilled artisan that the nucleobase editing proteins provided herein, e.g., the fusion proteins comprising a polynucleotide programmable nucleotide binding domain (e.g., Cas9) and a nucleobase editing domain (e.g., an adenosine deaminase domain or a cytidine deaminase domain) can be used to correct any single point A to G or C to T mutation. In the first case, deamination of the mutant A to I corrects the mutation, and in the latter case, deamination of the A that is base-paired with the mutant T, followed by a round of replication, corrects the mutation.

In some embodiments, the present disclosure provides base editors that can efficiently generate an intended mutation, such as a point mutation, in a nucleic acid (e.g., a nucleic acid within a genome of a subject) without generating a significant number of unintended mutations, such as unintended point mutations. In some embodiments, an intended mutation is a mutation that is generated by a specific base editor (e.g., cytidine base editor or adenosine base editor) bound to a guide polynucleotide (e.g., gRNA), specifically designed to generate the intended mutation. In some embodiments, the intended mutation is a mutation associated with a disease or disorder. In some embodiments, the intended mutation is an adenine (A) to guanine (G) point mutation associated with a disease or disorder. In some embodiments, the intended mutation is a cytosine (C) to thymine (T) point mutation associated with a disease or disorder. In some embodiments, the intended mutation is an adenine (A) to guanine (G) point mutation within the coding region or non-coding region of a gene. In some embodiments, the intended mutation is a cytosine (C) to thymine (T) point mutation within the coding region or non-coding region of a gene. In some embodiments, the intended mutation is a point mutation that generates a stop codon, for example, a premature stop codon within the coding region of a gene. In some embodiments, the intended mutation is a mutation that eliminates a stop codon.

In some embodiments, any of the base editors provided and described herein are capable of generating a ratio of intended mutations to unintended mutations (e.g., intended point mutations:unintended point mutations) that is greater than 1:1. In some embodiments, any of the base editors provided herein are capable of generating a ratio of intended mutations to unintended mutations (e.g., intended point mutations:unintended point mutations) that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more.

Details of base editor efficiency are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

In some embodiments, the formation of at least one intended mutation results in substitution of a pathogenic amino acid of a disease-causing protein with a benign amino acid that is different than a wild-type non-disease-causing protein, thereby treating a genetic disorder by substituting the pathogenic amino acid with a benign amino acid. It should be appreciated that the characteristics of the multiplex editing of the base editors as described herein can be applied to any of combination of the methods of using the base editors provided herein.

Pathogenic Amino Acid Substitution to Benign Alternate Alleles

In some embodiments, the intended mutation is a mutation that can convert a pathogenic mutation or a disease-causing mutation to a benign mutation. Non-limiting exemplary conversions of pathogenic mutations to benign alternate alleles are listed in the below Tables 3A and 3B. The benign edits illustrated in Tables 3A and 3B represent alternative changes that have the potential to correct a pathological mutation in lieu of performing a precise correction to revert to wild-type. Details of the nomenclature of the description of mutations and other sequence variations are described in den Dunnen, J. T. and Antonarakis, S. E., "Mutation Nomenclature Extensions and Suggestions to Describe Complex Mutations: A Discussion." Human Mutation 15:712 (2000), the entire contents of which is hereby incorporated by reference. In some embodiments, the disease or disorder is alpha-1 antitrypsin deficiency (A1AD), and the pathogenic mutation is in the SERPINA1 gene that encodes A1AT. In an embodiment, the pathogenic mutation of SERPINA1 is E342K (PiZ allele). In another embodiment, the pathogenic mutation of SERPINA1 is E264V (PiS allele).

Table 3A presents representative disease genes in which pathogenic amino acid substitutions to benign alternative alleles are shown. By way of example, one or more mutations in the medium chain acyl-CoA dehydrogenase (ACADM) gene is associated with and/or a cause of Medium chain acyl-CoA dehydrogenase deficiency. A representative human ACADM amino acid sequence is found under UniProtKB Reference No. P11310. One or more mutations in the SLC26A4; Solute Carrier Family 26 Member 4 (PDS) gene encoding the Pendrin protein is associated with and/or a cause of Pendred Syndrome. A representative human Pendrin amino acid sequence is found under UniProtKB Reference No. O43511-1. One or more mutations in the alpha-synuclein (SNCA) gene is associated with and/or a cause of autosomal dominant Parkinson's disease. A representative human alpha synuclein (SCNA) amino acid sequence is found under UniProtKB Reference No. P37840.

Figure 3:
FIG. 3 depicts the sequence of the target site for the correction of E342K within the SERPINA1 gene which encodes A1AT. Highlighted is the non-canonical spCas9 NGC PAM, as well as the target A nucleobase for which editing will result in the desired correction of E342K. Also noted are additional off-target A's for which editing may result in benign alleles such as E342G or D341G.
Figure 4:
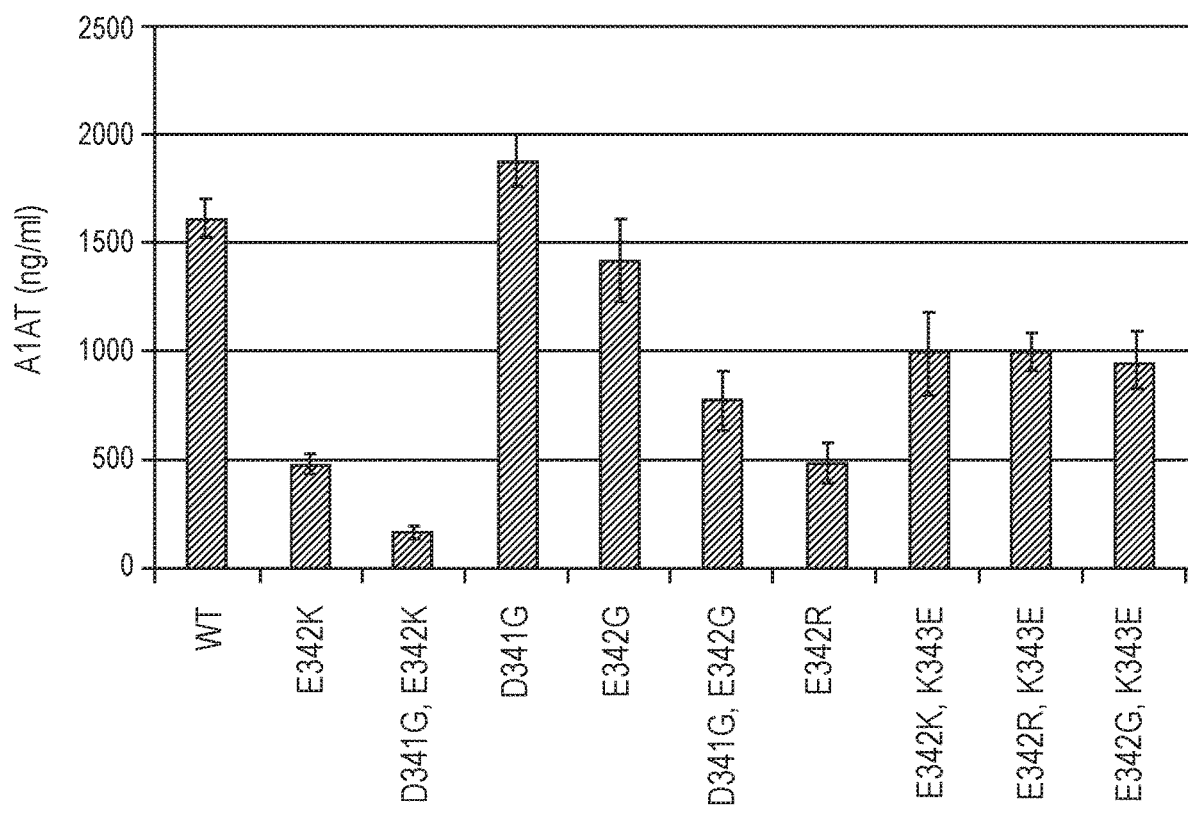
FIG. 4 is a bar graph showing the level of secreted protein in culture supernatants of HEK293T transiently transfected with plasmids encoding different variants of the A1AT protein. A1AT concentrations were determined by ELISA using published methods (Borel et al., 2017, "Alpha-1 Antitrypsin Deficiency: Methods and Protocols," 10.1007/ 978-1-4939-7163-3). The two most common clinical variants (e.g., pathogenic mutations) of A1AT are E264V (PiS allele) and E342K (PiZ allele). The PiS and PiZ proteins are produced in lower abundance than wildtype protein. Either the D341G or the E342G proteins is produced at levels similar to wildtype. Accordingly, adenine base editors and base editing methods as described herein were used to produce these benign alleles that restore A1AT secretion from hepatocytes and can simultaneously ameliorate liver toxicity and increase circulation of A1AT to the lungs. In the figure, A1AT: alpha-1 antitrypsin; A1AD: alpha-1 antitrypsin deficiency; "Z mutation" is the E342K (PiZ allele) mutation; "S mutation" is the E264V (PiS allele).
Figure 5:
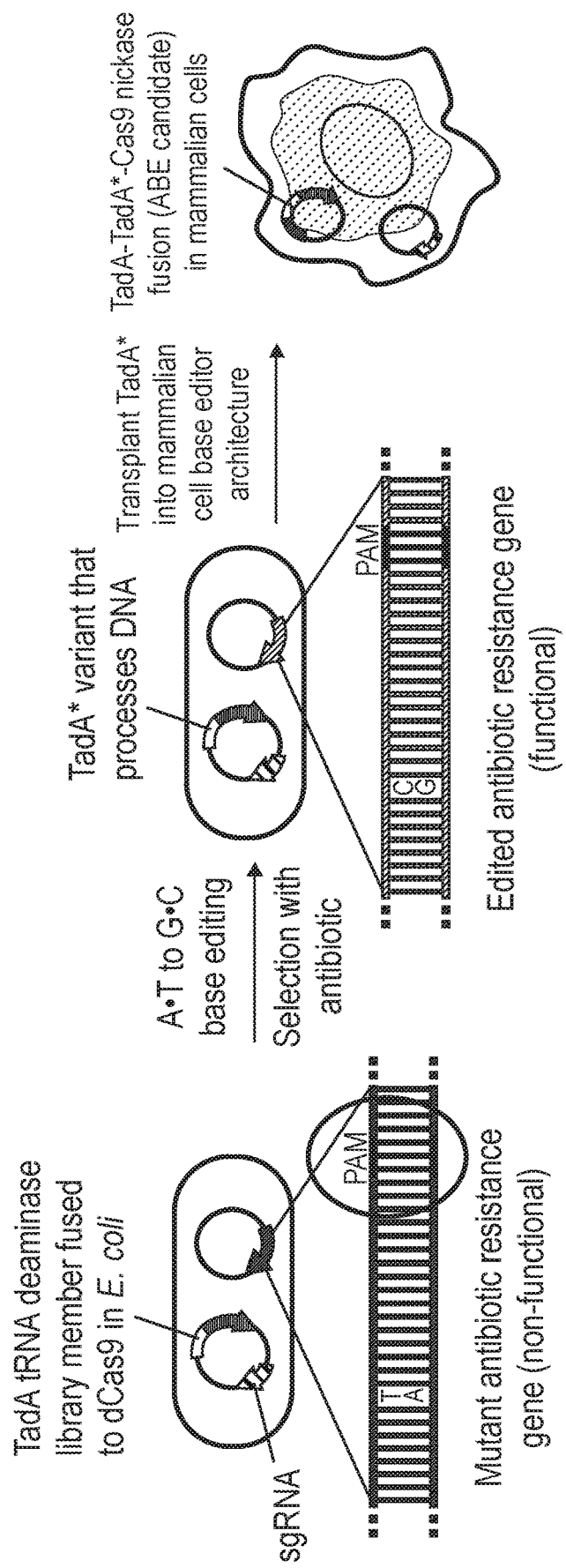
FIG. 5 is a schematic diagram showing a strategy in which a DNA deoxyadenosine deaminase is evolved starting from TadA. A library of E. coli harbors a plasmid library of mutant ecTadA (TadA*) genes fused to dCas9 and a selection plasmid requiring targeted A•T to G•C mutations to repair antibiotic resistance genes. Mutations from surviving TadA* variants were imported into an ABE architecture for base editing in human cells.

In a particular embodiment, the A nucleobase at positions 5 and 7 of the SERPINA1 gene were deaminated to yield a D341G allele. Base editing of the SERPINA1 gene sequence as described herein can result in D341G, E342G, E342R, K343E, or K343G substitutions in the encoded A1AT protein. In an embodiment, the A nucleobase at positions 7 and 8 of the SERPINA1 gene were deaminated to yield an E342G allele. In an embodiment, base editing of the E342K pathogenic mutation resulted in an E342G benign allele (FIG. 3 and FIG. 4). In some embodiments, the base editing may result in an off-target edit. In an embodiment, the off-target edit is D341G of the SERPINA1 E342K (PiZ) allele (FIG. 3 and FIG. 4). In an embodiment, the pathogenic amino acid substitution with the base editor results in a change from E7V to E7I in the Hb protein encoded by the HBB gene. In an embodiment, the pathogenic amino acid substitution with the base editor results in a change from E6V to E6A (E7V to E7A) in the mature form of β-globin encoded by the HBB gene (Table 3B).

TABLE 3A

Conversion of pathogenic amino acid substitutions
to benign alternative alleles of disease genes

| | Gene | Pathogenic > Alternate Allele | Base Editor | SEQ ID NO: | gRNA Targeting Sequence | PAM |
|---|---|---|---|---|---|---|
| 1. | ACADM | K329E>K329G | ABE | 167 | CAAUGGAAGUUGAACUAGCU | NGA |
| 2. | PDS | T416P>T416F | CBE | 168 | GAGCCCUGGAGGAAAGACAC | NGG |
| 3. | SNCA | A30P>A30L | CBE | 169 | AGCACCAGGAAAGACAAAAG | NGG |
| 4. | SERPINA1 | E342K>E342G | ABE | 170 | GACAAGAAAGGGACUGAAGC | NGC |

TABLE 3B

Conversion of pathogenic amino acid substitutions
to benign alternative alleles in the HBB gene

| | Gene | Pathogenic > Alternate Allele | Base Editor | SEQ ID NO: | gRNA Targeting Sequence | PAM |
|---|---|---|---|---|---|---|
| 1. | HBB | E6V > E6A | ABE | 8 | UCCACAGGAGUCAGAUGCAC (CATGGT) | NNNRRT* |
| 2. | HBB | E6V > E6A | ABE | 171 | UGAAGAGGUGUCCUCAGUCUA (CGTGGT) | NNACCA |
| 3. | HBB | E6V > E6A | ABE | 172 | UCUGAAGAGGUGUCCUCAGUCU (ACG) | NGC |
| 4. | HBB | E26K > E26G | ABE | 173 | UGGUAAGGCCCUGGGCAGGU | NGG |

Introduction of Gene Regulatory Edits

In some embodiments, the purpose of the methods provided herein is to restore the function of a dysfunctional gene via genome editing. In some embodiments, the function of a dysfunctional gene is restored by introducing an intended mutation. In some embodiments, the intended mutation is a mutation that alters the regulatory sequence of agene (e.g., a gene promotor or gene repressor). In some embodiments, the intended mutation is a mutation introducing gene regulator edits. Non-limiting exemplary introduction of gene regulator edits associated with certain genes, e.g., BAF Chromatin Remodeling Complex Component (BCL11A) gene associated with Intellectual Developmental Disorder with Hereditary Persistance of Fetal Hemoglobin (HPFH) and Fetal Hemoglobin Quantitative Trait 5; Gamma Globin genes HBG1 and HBG2; 5-aminolevulinate synthase 1 (ALAS1), erythroid form, which is a rate-limiting enzyme in the mammalian heme biosynthetic pathway; and low density lipoprotein receptor (LDLR), which binds to low density lipoprotein (LDL) particles that carry cholesterol in the blood and which is involved in receptor-mediated endocytosis of specific ligands, are listed in Table 4 below. Details of the nomenclature of the description of mutations and other sequence variations presented in Table 4 are described in den Dunnen, J. T. and Antonarakis, S. E., "Mutation Nomenclature Extensions and Suggestions to Describe Complex Mutations: A Discussion." Human Mutation 15:712 (2000), the entire contents of which is hereby incorporated by reference. Without limitation, the human BCL11A amino acid sequence is found under GenBank Accession No. ADL 14508 and its nucleic acid coding sequence is found under GenBank Accession No. GU324937.1. The amino acid and nucleic acid sequences of human HBG1 and HBG2 are found under NCBI Reference Sequence Nos. NM_000559.2 and NB_000184.3, respectively. The human ALAS1 amino acid and nucleic sequences are found under UniProtKB Accession No. Q5JAM2 and NCBI Reference Sequence No. NM_000688.6. The human LDLR amino acid sequence is found under NCBI Accession No. NP_000518.1 and its nucleic acid coding sequence is found under NCBI Accession No. NP_000527.4.

In some embodiments, the base editor provided herein can introduce an intended mutation at a distant site. The distant site includes, but is not limited to, a gene promoter and/or enhancer and an exon or intron. In some embodiments, the intended mutation is a mutation that alters the splicing of a gene. In some embodiments, the intended mutation altering the splicing of a gene is within an exon or an intron. In some embodiments, the intended mutation altering the splicing of a gene diminishes splicing rates. In some embodiments, the intended mutation altering the splicing of a gene increases splicing rates. In some embodiments, the intended mutation within a promoter and/or enhancer of a gene increases transcription. In some embodiments, the increase in transcription is due to the intended mutation within a promoter and/or enhancer of a gene reducing/removing binding by repressor protein(s). In some embodiments, the increase in transcription is due to the intended mutation within a promoter and/or enhancer of a gene permitting binding of a novel transcriptional activator protein(s). In some embodiments, the intended mutation within a promoter and/or enhancer of a gene decreases transcription. In some embodiments, the decrease in transcription is due to the intended mutation within a promoter and/or enhancer of a gene permitting binding of a novel repressor protein(s). In some embodiments, the decrease in transcription is due to the intended mutation within a promoter and/or enhancer of a gene reducing/removing binding by transcriptional activator protein(s).

TABLE 4

Introduction of Gene Regulator Edits

| | Gene | Nucleotide change | Base Editor | SEQ ID NO: | gRNA Targeting Sequence | PAM |
|---|---|---|---|---|---|---|
| 1. | BCL11A | c. 386-24278G > A | ABE | 172 | UGAAAGAAAUUAAACACAAA | NGA |
| 2. | BCL11A | c. 386-24983T > C | CBE | 175 | UUCCUGCACCGAAGCUUUGC | NGT |
| 3. | HBG1 | c. -167C > T | CBE | 176 | CUUGACCAAUAGCCUUGACA | NGG |
| 4. | HBG1 | c. -170G > A | CBE | 177 | GCUAUUGGUCAAGGCAAGGC | NGG |
| 5. | HBG1 | c. -249C > T | CBE | 178 | CUUCCCCACACUAUCUCAAU | NNNRRT |
| 6. | HBG2 | c. -211C > T | CBE | | | |
| 7. | HBG2 | c. -228T > C | ABE | 179 | AUAUUUGCAUUGAGAUAGUG | NGG |
| 8. | ALAS1 | c. 3G > A | CBE | 180 | CUCUCCAUGUUCAGGAAGUA | TGCT |
| 9. | ALAS1 | c. 2T > C | ABE | 180 | CUCUCCAUGUUCAGGAAGUA | TGCT |
| 10. | ALAS1 | c. 46C > T | CBE | 181 | AGUCCLDCCCAGGCCUUUCUG AGAAC | |
| 11. | ALAS1 | c. 91C > T | CBE | 182 | CUAUGCCCAAAACUGCCCCA | AGAT |
| 12. | ALAS1 | c. 91C > T | CBE | 183 | UGCCCAAAACUGCCCCAAGA | TGAT |
| 13. | ALAS1 | c. 226C > T | CBE | 184 | AAGGUCCAACAGACUCCUGA | TGG |
| 14. | ALAS1 | c. 229C > T | CBE | 184 | AAGGUCCAACAGACUCCUGA | TGG |
| 15. | ALAS1 | c. 226C > T | CBE | 185 | AGGUCCAACAGACUCCUGAU | GGAT |
| 16. | ALAS1 | c. 229C > T | CBE | 185 | AGGUCCAACAGACUCCUGAU | GGAT |
| 17. | ALAS1 | c. 247C > T | CBE | 186 | GGAUCCCAGCAGAGUCCAGA | TGG |
| 18. | ALAS1 | c. 250C > T | CBE | 186 | GGAUCCCAGCAGAGUCCAGA | TGG |
| 19. | ALAS1 | c. 247C > T | CBE | 187 | GAUCCCAGCAGAGUCCAGAU | GGCA |
| 20. | ALAS1 | c. 250C > T | CBE | 187 | GAUCCCAGCAGAGUCCAGAU | GGCA |
| 21. | ALAS1 | c. 340C > T | CBE | 188 | GCAGCACAGAUGAAUCAGAG | AGG |
| 22. | ALAS1 | c. 340C > T | CBE | 189 | CAGCACAGAUGAAUCAGAGA | GGCA |
| 23. | ALAS1 | c. 349C > T | CBE | 190 | AUGAAUCAGAGAGGCAGCAG | TGTC |
| 24. | ALAS1 | c. 391C > T | CBE | 191 | UGAGCUUCAGGAGGAUGUGC | AGG |
| 25. | ALAS1 | c. 391C > T | CBE | 192 | GAGCUUCAGGAGGAUGUGCA | GGAA |
| 26. | ALAS1 | c. 403C > T | CBE | 193 | GAUGUGCAGGAAAUGAAUGC | CGTG |
| 27. | ALAS1 | c. 403C > T | CBE | 194 | UGUGCAGGAAAUGAAUGCCG | TGAG |
| 28. | ALAS1 | c. 199 + 1G > A | CBE | 195 | CUUACUCUCACUGGCCGGAG | GGG |
| 29. | ALAS1 | c. 199 + 2T > C | ABE | 195 | CUUACUCUCACUGGCCGGAG | GGG |
| 30. | ALAS1 | c. 199 + 1G > A | CBE | 196 | ACUUACUCUCACUGGCCGGA | GGG |
| 31. | ALAS1 | c. 199 + 2T > C | ABE | 196 | ACUUACUCUCACUGGCCGGA | GGG |
| 32. | ALAS1 | c. 199 + 1G > A | CBE | 197 | CACUUACUCUCACUGGCCGG | AGG |
| 33. | ALAS1 | c. 199 + 2T > C | ABE | 197 | CACUUACUCUCACUGGCCGG | AGG |
| 34. | ALAS1 | c. 199 + 1G > A | CBE | 198 | UGCACUUACUCUCACUGGC | CGG |
| 35. | ALAS1 | c. 199 + 2T > C | ABE | 198 | UGCACUUACUCUCACUGGC | CGG |
| 36. | ALAS1 | c. 200 - 1G > A | CBE | 199 | UUGUCUUCUGAGGGAGGAAA | TGG |
| 37. | ALAS1 | c. 200 - 2A > G | ABE | 200 | CUCAGAAGACAAACUGCUA | AGG |

TABLE 4-continued

Introduction of Gene Regulator Edits

| | Gene | Nucleotide change | Base Editor | SEQ ID NO: | gRNA Targeting Sequence | PAM |
|---|---|---|---|---|---|---|
| 38. | ALAS1 | c. 427 + 1G > A | CBE | 201 | UCAUCUCUUACCUUUCCUCA | CGG |
| 39. | ALAS1 | c. 427 + 2T > C | ABE | 201 | UCAUCUCUUACCUUUCCUCA | CGG |
| 40. | ALAS1 | c. 1165 + 1G > A | CBE | 202 | CACACUUACCAUCCAUUGAA | TGG |
| 41. | ALAS1 | c. 1165 + 2T > C | ABE | 202 | CACACUUACCAUCCAUUGAA | TGG |
| 42. | ALAS1 | c. 1166 − 1A > G | ABE | 203 | CUCAGGGGCGGUGUGCCCAC | TGG |
| 43. | ALAS1 | c. 1331 − 2A > G | ABE | 204 | CUCCUCCCAGGCAAAGCCUU | TGG |
| 44. | HBG1/2 | c. −198 T > C | ABE | 205 | GUGGGGAAGGGGCCCCCAAG | AGG |
| 45. | HBG1/2 | c. −198 T > C | ABE | 206 | AUUGAGAUAGUGUGGGGAAG | GGG |
| 46. | HBG1/2 | c. −198 T > C | ABE | 207 | CAUUGAGAUAGUGUGGGGAA | GGG |
| 47. | HBG1/2 | c. −198 T > C | ABE | 208 | GCAUUGAGAUAGUGUGGGGA | AGG |
| 48. | HBG1/2 | c −114~−102 deletion | CBE and/or ABE | 177 | GCUAUUGGUCAAGGCAAGGC | TGG |
| 49. | HBG1/2 | c. −114~−102 deletion | CBE and/or ABE | 209 | CAAGGCUAUUGGUCAAGGCA | AGG |
| 50. | HBG1/2 | c. −114~−102 deletion | CBE and/or ABE | 210 | CUUGUCAAGGCUAUUGGUCA | AGG |
| 51. | HBG1/2 | c. −114~−102 deletion | CBE and/or ABE | 176 | CUUGACCAAUAGCCUUGACA | AGG |
| 52. | HBG1/2 | c. −114~−102 deletion | CBE and/or ABE | 211 | GUUUGCCUUGUCAAGGCUAU | TGG |
| 53. | HBG1/2 | c. −114~−102 deletion | CBE and/or ABE | 212 | UGGUCAAGUUUGCCUUGUCA | AGG |
| 54. | HBG1/2 | c. −198 T > C | ABE | 213 | UGGGGAAGGGCCCCCAAGA | GGA |
| 55. | HBG1/2 | c. −198 T > C | ABE | 214 | GUGUGGGGAAGGGGCCCCCA | AGA |
| 56. | HBG1/2 | c. −175 T > C | ABE | 215 | UCAGACAGAUAUUUGCAUUG | AGA |
| 57. | HBG1/2 | c. −175 T > C | ABE | 216 | UUUCAGACAGAUAUUUGCAU | TGA |
| 58. | HBG1/2 | c. −114~−102 deletion | CBE and/or ABE | 217 | CUUGCCUUGACCAAUAGCCU | TGA |
| 59. | HBG1/2 | c. −114~−102 deletion | CBE and/or ABE | 218 | UAGCCUUGACAAGGCAAACU | TGA |
| 60. | HBG1/2 | c. −90 BCL11A binding | CBE and/or ABE | 219 | CAAACUUGACCAAUAGUCUU | AGA |
| 61. | HBG1/2 | c. −198 T > C | ABE | 220 | UGUGGGGAAGGGGCCCCCAA | GAGGAT |
| 62. | HBG1/2 | c. −202 C > T, −201 C > T, −198 T > C, −197 C > T, −196 C > T, −195 C > G | CBE and/or ABE | 221 | GGGCCCCUUCCCCACACUAU | CTCAAT |
| 63. | HBG1/2 | c. −197 C > T, −196 C > T, −195 C > G | CBE | 178 | CUUCCCCACACUAUCUCAAU | GCAAAT |

TABLE 4-continued

Introduction of Gene Regulator Edits

| | Gene | Nucleotide change | Base Editor | SEQ ID NO: | gRNA Targeting Sequence | PAM |
|---|---|---|---|---|---|---|
| 64. | HBG1/2 | c. -175 T > C | ABE | 222 | CAGACAGAUAUUUGCAUUGA | GATAGT |
| 65. | HBG1/2 | c. -175 T > C | ABE | 216 | UUUCAGACAGAUAUUUGCAU | TGAGAT |
| 66. | HBG1/2 | c. -114--102 deletion | CBE | 223 | AAGUUUGCCUUGUCAAGGCU | ATTGGT |
| 67. | HBG1/2 | c. -114--102 deletion | CBE and/or ABE | 224 | GCCUUGACAAGGCAAACUUG | ACCAAT |
| 68. | HBG1/2 | c. -114--102 deletion | CBE and/or ABE | 225 | UUGACAAGGCAAACUUGACC | AATAGT |
| 69. | HBG1/2 | c. -90 BCL11A binding | CBE and/or ABE | 226 | UGACCAAUAGUCUUAGAGUA | TCCAGT |
| 70. | HBG1/2 | c. -175 T > C | ABE | 227 | AGACAGAUAUUUGCAUUGAGA TTTUA | |
| 71. | LDLR | c. 81C > T | CBE | 228 | CAGAUGCGAAAGAAACGAGU | NNNRRT |

Delivery System

A base editor disclosed herein can be encoded on a nucleic acid that is contained in a viral vector. Exemplary viral vectors include retroviral vectors (e.g. Maloney murine leukemia virus, MML-V), adenoviral vectors (e.g. AD100), lentiviral vectors (HIV and FIV-based vectors), herpesvirus vectors (e.g. HSV-2), and adeno-associated viral vectors.

Adeno-Associated Viral Vectors (AAVs)

AAVAdeno-associated virus ("AAV") vectors can also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

In terms of in vivo delivery, AAV can be advantageous over other viral vectors. In some cases, AAV allows low toxicity, which can be due to the purification method not requiring ultra-centrifugation of cell particles that can activate the immune response. In some cases, AAV allows low probability of causing insertional mutagenesis because it doesn't integrate into the host genome.

AAV is a small, single-stranded DNA dependent virus belonging to the parvovirus family. The 4.7 kb wild-type (wt) AAV genome is made up of two genes that encode four replication proteins and three capsid proteins, respectively, and is flanked on either side by 145-bp inverted terminal repeats (ITRs). The virion is composed of three capsid proteins, Vp1, Vp2, and Vp3, produced in a 1:1:10 ratio from the same open reading frame but from differential splicing (Vp1) and alternative translational start sites (Vp2 and Vp3, respectively). Vp3 is the most abundant subunit in the virion and participates in receptor recognition at the cell surface defining the tropism of the virus. A phospholipase domain, which functions in viral infectivity, has been identified in the unique N terminus of Vp1.

AAV has a packaging limit of 4.5 or 4.75 Kb. Accordingly, a disclosed base editor as well as a promoter and transcription terminator can be harbored in a single viral vector. Constructs larger than 4.5 or 4.75 Kb can lead to significantly reduced virus production. For example, SpCas9 is quite large, the gene itself is over 4.1 Kb, which makes it difficult for packing into AAV. Therefore, embodiments of the present disclosure include utilizing a disclosed base editor which is shorter in length than conventional base editors. In some examples, the base editors are less than 4 kb. Disclosed base editors can be less than 4.5 kb, 4.4 kb, 4.3 kb, 4.2 kb, 4.1 kb, 4 kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb. In some cases, the disclosed base editors are 4.5 kb or less in length.

An AAV can be AAV1, AAV2, AAV5 or any combination thereof. One can select the type of AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. A tabulation of certain AAV serotypes as to these cells can be found in Grimm, D. et al, J. Virol. 82: 5887-5911 (2008)).

Similar to wt AAV, recombinant AAV (rAAV) utilizes the cis-acting 145-bp ITRs to flank vector transgene cassettes, providing up to 4.5 kb for packaging of foreign DNA. Subsequent to infection, rAAV can express a fusion protein of the invention and persist without integration into the host genome by existing episomally in circular head-to-tail concatemers. Although there are numerous examples of rAAV success using this system, in vitro and in vivo, the limited packaging capacity has limited the use of AAV-mediated gene delivery when the length of the coding sequence of the gene is equal or greater in size than the wt AAV genome.

The small packaging capacity of AAV vectors makes the delivery of a number of genes that exceed this size and/or the use of large physiological regulatory elements challenging. These challenges can be addressed, for example, by dividing the protein(s) to be delivered into two or more fragments, wherein the N-terminal fragment is fused to a split intein-N and the C-terminal fragment is fused to a split intein-C. These fragments are then packaged into two or more AAV vectors. As used herein, "intein" refers to a self-splicing protein intron (e.g., peptide) that ligates flanking N-terminal and C-terminal exteins (e.g., fragments to be joined). The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

A fragment of a fusion protein of the invention can vary in length. In some embodiments, a protein fragment ranges from 2 amino acids to about 1000 amino acids in length. In some embodiments, a protein fragment ranges from about 5 amino acids to about 500 amino acids in length. In some embodiments, a protein fragment ranges from about 20 amino acids to about 200 amino acids in length. In some embodiments, a protein fragment ranges from about 10 amino acids to about 100 amino acids in length. Suitable protein fragments of other lengths will be apparent to a person of skill in the art.

In some embodiments, a portion or fragment of a nuclease (e.g., Cas9) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, the N-terminus of an intein is fused to the C-terminus of a fusion protein and the C-terminus of the intein is fused to the N-terminus of an AAV capsid protein.

In one embodiment, dual AAV vectors are generated by splitting a large transgene expression cassette in two separate halves (5' and 3' ends, or head and tail), where each half of the cassette is packaged in a single AAV vector (of <5 kb). The re-assembly of the fill-length transgene expression cassette is then achieved upon co-infection of the same cell by both dual AAV vectors followed by: (1) homologous recombination (HR) between 5' and 3' genomes (dual AAV overlapping vectors); (2) ITR-mediated tail-to-head concatemerization of 5' and 3' genomes (dual AAV trans-splicing vectors); or (3) a combination of these two mechanisms (dual AAV hybrid vectors). The use of dual AAV vectors in vivo results in the expression of full-length proteins. The use of the dual AAV vector platform represents an efficient and viable gene transfer strategy for transgenes of >4.7 kb in size.

The use of RNA or DNA viral based systems for the delivery of a base editor takes advantage of highly evolved processes for targeting a virus to specific cells in culture or in the host and trafficking the viral payload to the nucleus or host cell genome. Viral vectors can be administered directly to cells in culture, patients (in vivo), or they can be used to treat cells in vitro, and the modified cells can optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).

Retroviral vectors, especially lentiviral vectors, can require polynucleotide sequences smaller than a given length for efficient integration into a target cell. For example, retroviral vectors of length greater than 9 kb can result in low viral titers compared with those of smaller size. In some aspects, a base editor of the present disclosure is of sufficient size so as to enable efficient packaging and delivery into a target cell via a retroviral vector. In some cases, a base editor is of a size so as to allow efficient packing and delivery even when expressed together with a guide nucleic acid and/or other components of a targetable nuclease system.

In applications where transient expression is preferred, adenoviral based systems can be used. Adenoviral based vectors are capable of very high transduction efficiency in many cell types and do not require cell division. With such vectors, high titer and levels of expression have been obtained. This vector can be produced in large quantities in a relatively simple system.

A base editor described herein can therefore be delivered with viral vectors. One or more components of the base editor system can be encoded on one or more viral vectors. For example, a base editor and guide nucleic acid can be encoded on a single viral vector. In other cases, the base editor and guide nucleic acid are encoded on different viral vectors. In either cases, the base editor and guide nucleic acid can each be operably linked to a promoter and terminator.

The combination of components encoded on a viral vector can be determined by the cargo size constraints of the chosen viral vector.

Any suitable promoter can be used to drive expression of the base editor and, where appropriate, the guide nucleic acid. For ubiquitous expression, promoters that can be used include CMV, CAG, CBh, PGK, SV40, Ferritin heavy or light chains, etc. For brain or other CNS cell expression, suitable promoters can include: SynapsinI for all neurons, CaMKIIalpha for excitatory neurons, GAD67 or GAD65 or VGAT for GABAergic neurons, etc. For liver cell expression, suitable promoters include the Albumin promoter. For lung cell expression, suitable promoters can include SP-B. For endothelial cells, suitable promoters can include ICAM. For hematopoietic cells suitable promoters can include IFN-beta or CD45. For osteoblasts. suitable promoters can include OG-2.

A promoter used to drive base editor coding nucleic acid molecule expression can include AAV ITR. This can be advantageous for eliminating the need for an additional promoter element, which can take up space in the vector. The additional space freed up can be used to drive the expression of additional elements, such as a guide nucleic acid or a selectable marker. ITR activity is relatively weak, so it can be used to reduce potential toxicity due to over expression of the chosen nuclease.

In some cases, a base editor of the present disclosure is of small enough size to allow separate promoters to drive expression of the base editor and a compatible guide nucleic acid within the same nucleic acid molecule. For instance, a vector or viral vector can comprise a first promoter operably linked to a nucleic acid encoding the base editor and a second promoter operably linked to the guide nucleic acid.

The promoter used to drive expression of a guide nucleic acid can include: Pol III promoters such as U6 or H1 Use of Pol II promoter and intronic cassettes to express gRNA Adeno Associated Virus (AAV).

A base editor described herein with or without one or more guide nucleic can be delivered using adeno-associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific base editing, the expression of the base editor and optional guide nucleic acid can be driven by a cell-type specific promoter.

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses can be prepared as follows. After cloning pCasES10 (which contains a lentiviral transfer plasmid backbone), HEK293FT cells at low passage (p=5) were seeded in a T-75 flask to 50% confluence the day before transfection in DMEM with 10% fetal bovine serum and without antibiotics. After 20 hours, the medium was changed to OptiMEM (serum-free) media and transfection was done 4 hours later. Cells were transfected with 10 μg of lentiviral transfer plasmid (pCasES10) and the following packaging plasmids: 5 μg of pMD2.G (VSV-g pseudotype), and 7.5 μg of psPAX2 (gag/pol/rev/tat). Transfection can be done in 4 mL OptiMEM with a cationic lipid delivery agent (50 μl Lipofectamine 2000 and 100 ul Plus reagent). After 6 hours, the medium was changed to antibiotic-free DMEM with 10% fetal bovine serum. These methods used serum during cell culture, but serum-free methods are optimal.

Lentivirus can be purified as follows. Viral supernatants are harvested after 48 hours. Supernatants are first cleared of debris and filtered through a 0.45 μm low protein binding (PVDF) filter. They are then spun in a ultracentrifuge for 2 hours at 24,000 rpm. Viral pellets are resuspended in 50 μl of DMEM overnight at 4° C. and are then aliquoted and immediately frozen at −80° C.

In another embodiment, minimal non-primate lentiviral vectors based on the equine infectious anemia virus (EIAV) are also contemplated. In another embodiment, RetinoStat®, an equine infectious anemia virus-based lentiviral gene therapy vector that expresses angiostatic proteins endostatin and angiostatin that is contemplated to be delivered via a subretinal injection. In another embodiment, use of self-inactivating lentiviral vectors is contemplated.

Any RNA of the systems, for example a guide RNA or a base editor-encoding mRNA, can be delivered in the form of RNA. Base editor-encoding mRNA can be generated using in vitro transcription. For example, nuclease mRNA can be synthesized using a PCR cassette containing the following elements: T7 promoter, optional kozak sequence (GC-CACC), nuclease sequence, and 3' UTR such as a 3' UTR from beta globin-polyA tail. The cassette can be used for transcription by 17 polymerase. Guide polynucleotides (e.g., gRNA) can also be transcribed using in vitro transcription from a cassette containing a 17 promoter, followed by the sequence "GG", and guide polynucleotide sequence.

To enhance expression and reduce possible toxicity, the base editor-coding sequence and/or the guide nucleic acid can be modified to include one or more modified nucleoside e.g. using pseudo-U or 5-Methyl-C.

The disclosure in some embodiments encompasses a method of modifying a cell or organism. The cell can be a prokaryotic cell or a eukaryotic cell. The cell can be a mammalian cell. The mammalian cell may be a human, non-human primate, bovine, porcine, rodent or mouse cell. The modification introduced to the cell by the base editors, compositions and methods of the present disclosure can be such that the cell and progeny of the cell are altered for improved production of biologic products such as a protein, an antibody, starch, alcohol or other desired cellular output. The modification introduced to the cell by the methods of the present disclosure can be such that the cell and progeny of the cell include an alteration that changes the biologic product produced, e.g., a disease-associated protein product.

The system can comprise one or more different vectors. In an aspect, the base editor is codon optimized for expression the desired cell type, preferentially a eukaryotic cell, preferably a mammalian cell or a human cell.

In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusaorjp/codon/(visited Jul. 9, 2002), and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding an engineered nuclease correspond to the most frequently used codon for a particular amino acid.

Packaging cells are typically used to form virus particles that are capable of infecting a host cell. Such cells include 293 cells, which package adenovirus, and psi.2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA can be packaged in a cell line, which contains a helper plasmid encoding the other AAV genes, namely rep and cap, but lacking ITR sequences. The cell line can also be infected with adenovirus as a helper. The helper virus can promote replication of the AAV vector and expression of AAV genes from the helper plasmid. The helper plasmid in some cases is not packaged in significant amounts due to a lack of ITR sequences. Contamination with adenovirus can be reduced by, e.g., heat treatment to which adenovirus is more sensitive than AAV.

Non-Viral Delivery of Base Editors

Non-viral delivery approaches for base editors are also available. One important category of non-viral nucleic acid vectors is nanoparticles, which can be organic or inorganic. Nanoparticles are well known in the art. Any suitable nanoparticle design can be used to deliver genome editing system components or nucleic acids encoding such components. For instance, organic (e.g. lipid and/or polymer) nanoparticles can be suitable for use as delivery vehicles in certain embodiments of this disclosure. Exemplary lipids for use in nanoparticle formulations, and/or gene transfer are shown in Table 5 (below).

TABLE 5

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammoniun bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylpho sphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |

TABLE 5-continued

Lipids Used for Gene Transfer

| Lipid | Abbreviation | Feature |
|---|---|---|
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Table 6 lists exemplary polymers for use in gene transfer and/or nanoparticle formulations.

TABLE 6

Polymers Used for Gene Transfer

| Polymer | Abbreviation |
|---|---|
| Poly(ethylene)glycol | PEG |
| Polyethylenimine | PEI |
| Dithiobis (succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

Table 7 summarizes delivery methods for a polynucleotide encoding a fusion protein described herein.

TABLE 7

| Delivery | Vector/Mode | Delivery into Non-Dividing Cells | Duration of Expression | Genome Integration | Type of Molecule Delivered |
|---|---|---|---|---|---|
| Physical | (e.g., electroporation, particle gun, Calcium Phosphate transfection) | YES | Transient | NO | Nucleic Acids and Proteins |
| Viral | Retrovirus | NO | Stable | YES | RNA |
| | Lentivirus | YES | Stable | YES/NO with modification | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |

TABLE 7-continued

| Delivery | Vector/Mode | Delivery into Non-Dividing Cells | Duration of Expression | Genome Integration | Type of Molecule Delivered |
|---|---|---|---|---|---|
| | Biological liposomes: Erythrocyte Ghosts and Exosomes | YES | Transient | NO | Nucleic Acids |

In another aspect, the delivery of genome editing system components or nucleic acids encoding such components, for example, a nucleic acid binding protein such as, for example, Cas9 or variants thereof, and a gRNA targeting a genomic nucleic acid sequence of interest, may be accomplished by delivering a ribonucleoprotein (RNP) to cells. The RNP comprises the nucleic acid binding protein, e.g., Cas9, in complex with the targeting gRNA. RNPs may be delivered to cells using known methods, such as electroporation, nucleofection, or cationic lipid-mediated methods, for example, as reported by Zuris J. A. et al., 2015, *Nat. Biotechnology*, 33(1):73-80. RNPs are advantageous for use in CRISPR base editing systems, particularly for cells that are difficult to transfect, such as primary cells. In addition, RNPs can also alleviate difficulties that may occur with protein expression in cells, especially when eukaryotic promoters, e.g., CMV or EF1A, which may be used in CRISPR plasmids, are not well-expressed. Advantageously, the use of RNPs does not require the delivery of foreign DNA into cells. Moreover, because an RNP comprising a nucleic acid binding protein and gRNA complex is degraded over time, the use of RNPs has the potential to limit off-target effects. In a manner similar to that for plasmid based techniques, RNPs can be used to deliver binding protein (e.g., Cas9 variants) and to direct homology directed repair (HDR). In an embodiment, RNP delivery is suitable for the delivery of a nucleic acid binding protein and gRNA to cells for base editing associated with the treatment of hematological diseases, such as sickle cell disease (SCD) as described herein.

Pharmaceutical Compositions

Other aspects of the present disclosure relate to pharmaceutical compositions comprising any of the base editors, fusion proteins, or the fusion protein-guide polynucleotide complexes described herein. The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g., for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.).

Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

Pharmaceutical compositions can comprise one or more pH buffering compounds to maintain the pH of the formulation at a predetermined level that reflects physiological pH, such as in the range of about 5.0 to about 8.0. The pH buffering compound used in the aqueous liquid formulation can be an amino acid or mixture of amino acids, such as histidine or a mixture of amino acids such as histidine and glycine. Alternatively, the pH buffering compound is preferably an agent which maintains the pH of the formulation at a predetermined level, such as in the range of about 5.0 to about 8.0, and which does not chelate calcium ions. Illustrative examples of such pH buffering compounds include, but are not limited to, imidazole and acetate ions. The pH buffering compound may be present in any amount suitable to maintain the pH of the formulation at a predetermined level.

Pharmaceutical compositions can also contain one or more osmotic modulating agents, i.e., a compound that modulates the osmotic properties (e.g, tonicity, osmolality, and/or osmotic pressure) of the formulation to a level that is acceptable to the blood stream and blood cells of recipient individuals. The osmotic modulating agent can be an agent that does not chelate calcium ions. The osmotic modulating agent can be any compound known or available to those skilled in the art that modulates the osmotic properties of the formulation. One skilled in the art may empirically determine the suitability of a given osmotic modulating agent for use in the inventive formulation. Illustrative examples of suitable types of osmotic modulating agents include, but are not limited to: salts, such as sodium chloride and sodium acetate; sugars, such as sucrose, dextrose, and mannitol; amino acids, such as glycine; and mixtures of one or more of these agents and/or types of agents. The osmotic modulating agent(s) may be present in any concentration sufficient to modulate the osmotic properties of the formulation.

In some embodiments, the pharmaceutical composition is formulated for delivery to a subject, e.g., for gene editing or base editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump can be used (see, e.g., Langer, 1990, Science 249: 1527-1533; Sefton, 1989, CRC Crit. Ref. Biomed. Eng. 14:201; Buchwald et al., 1980, Surgery 88:507; Saudek et al, 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228:190; During et al., 1989, Ann. Neurol. 25:351; Howard et ah, 1989, J. Neurosurg. 71: 105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic use as solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration can be a liquid, e.g., sterile saline, lactated Ringer's or Hank's solution. In addition, the pharmaceutical composition can be in solid forms and re-dissolved or suspended immediately prior to use. Lyophilized forms are also contemplated. The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et ah, Gene Ther. 1999, 6: 1438-47). Positively charged lipids such as N-[1-(2,3-dioleoyloxi)propyl]-N,N,N-trimethyl-amonium-methylsulfate, or "DOTAP," are particularly preferred for such particles and vesicles. The preparation of such lipid particles is well known. See, e.g, U.S. Pat. Nos. 4,880,635; 4,906,477; 4,911,928; 4,917,951; 4,920,016; and 4,921,757; each of which is incorporated herein by reference.

The pharmaceutical composition described herein can be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments, the pharmaceutical composition comprises a ribonucleoprotein complex comprising an RNA-guided nuclease (e.g., Cas9) that forms a complex with a gRNA and a cationic lipid. In some embodiments pharmaceutical composition comprises a gRNA, a nucleic acid programmable DNA binding protein, a cationic lipid, and a pharmaceutically acceptable excipient. Pharmaceutical compositions can optionally comprise one or more additional therapeutically active substances.

Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein can be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit. Pharmaceutical formulations can additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, MD, 2006; incorporated in its entirety herein by reference) discloses various excipients used in formulating pharmaceutical compositions and known techniques for the preparation thereof. See also PCT application PCT/US2010/055131 (Publication number WO2011053982 A8, filed Nov. 2, 2010), incorporated in its entirety herein by reference, for additional suitable methods, reagents, excipients and solvents for producing pharmaceutical compositions comprising a nuclease.

Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

The compositions, as described above, can be administered in effective amounts. The effective amount will depend upon the mode of administration, the particular condition being treated, and the desired outcome. It may also depend upon the stage of the condition, the age and physical condition of the subject, the nature of concurrent therapy, if any, and like factors well-known to the medical practitioner. For therapeutic applications, it is that amount sufficient to achieve a medically desirable result.

Methods of Treating Diseases Associated with Pathological Mutations

Provided also are methods of treating a disease or disorder that involve the introduction of a base edit into a disease-associated or disease-causing gene as described herein, e.g., Tables 3A and 3B, supra, or into a regulatory sequence (e.g., a gene promoter, enhancer, or repressor) associated with, for example, a gene having a mutation, such as those as listed in Table 4 supra.

The method comprises administering to a subject (e.g., a mammal, such as a human) a therapeutically effective amount of a pharmaceutical composition that comprises a polynucleotide encoding a base editor system (e.g., base editor and gRNA) described herein. In some embodiments, the base editor is a fusion protein that comprises a polynucleotide programmable DNA binding domain and an adenosine deaminase domain or a cytidine deaminase domain. A cell of the subject is transduced with the base editor and one or more guide polynucleotides that target the base editor to effect an A•T to G•C alteration (if the cell is transduced with an adenosine deaminase domain) or a C•G to U•A alteration (if the cell is transduced with a cytidine deaminase domain) of a disease-associated gene, a disease-causing gene, or a regulatory nucleic acid sequence associated with a disease-causing gene.

The methods herein include administering to the subject (including a subject identified as being in need of such treatment, or a subject suspected of being at risk of disease and in need of such treatment) an effective amount of a composition described herein. Identifying a subject in need of such treatment can be in the judgment of a subject or a health care professional and can be subjective (e.g. opinion) or objective (e.g. measurable by a test or diagnostic method).

The therapeutic methods, in general, comprise administration of a therapeutically effective amount of a pharmaceutical composition comprising, for example, a vector encoding a base editor and a gRNA that targets a disease-causing gene, a disease-associated gene (e.g., as presented in Tables 3A and 3B supra), or a regulatory sequence (e.g., a gene promoter, enhancer, or repressor) associated with, for example, a disease gene listed in Table 4 of a subject (e.g., a human patient) in need thereof. Such treatment will be suitably administered to a subject, particularly a human subject, suffering from, having, susceptible to, or at risk for a disease or disorder. The compositions herein may be also used in the treatment of any other disorders in which the described genes or regulatory sequences of the described genes may be implicated.

In one embodiment, a method of monitoring treatment progress is provided. The method includes the step of determining a level of diagnostic marker (Marker) (e.g., a SNP associated with a disease-associated gene as described herein) or diagnostic measurement (e.g., screen, assay) in a subject suffering from or susceptible to a disorder or symptoms thereof associated with a certain gene associated with the disorder in which the subject has been administered a therapeutic amount of a composition herein sufficient to treat the disease or symptoms thereof. The level of Marker determined in the method can be compared to known levels of Marker in either healthy normal controls or in other afflicted patients to establish the subject's disease status. In preferred embodiments, a second level of Marker in the subject is determined at a time point later than the determination of the first level, and the two levels are compared to monitor the course of disease or the efficacy of the therapy. In certain preferred embodiments, a pre-treatment level of Marker in the subject is determined prior to beginning treatment according to this invention; this pre-treatment level of Marker can then be compared to the level of Marker in the subject after the treatment commences, to determine the efficacy of the treatment.

In some embodiments, cells are obtained from the subject and contacted with a pharmaceutical composition as provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of all of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts, for example, for veterinary use.

Kits

Various aspects of this disclosure provide kits or articles of manufacture comprising a base editor system. In one embodiment, the kit or article of manufacture comprises a nucleic acid construct comprising a nucleotide sequence encoding a nucleobase editor fusion protein. The fusion protein comprises a deaminase (e.g., cytidine deaminase or adenine deaminase) and a nucleic acid programmable DNA binding protein (napDNAbp). In some embodiments, the kit comprises at least one guide RNA capable of targeting a nucleic acid molecule of interest, e.g., a disease-causing gene, a disease-associated gene (such as provided in Tables 3A and 3B), or a regulatory sequence (e.g., a gene promoter, enhancer, or repressor), associated with, for example, a disease-related gene listed in Table 4. In some embodiments, the kit comprises a nucleic acid construct comprising a nucleotide sequence encoding at least one guide RNA.

The kit provides, in some embodiments, instructions for using the kit to edit one or more disease-associated or disease-causing genes, or one or more regulatory sequences associated with a disease-associated gene, for example, a gene listed in Tables 3A, 3B or 4, for example, SERPINA1, sickle cell genes (HBB), or HBG1/2 genes. The instructions will generally include information about the use of the kit for editing nucleic acid molecules. In other embodiments, the instructions include at least one of the following: precautions; warnings; clinical studies; and/or references. The instructions may be printed directly on the container (when present), or as a label applied to the container, or as a separate sheet, pamphlet, card, or folder supplied in or with the container. In a further embodiment, a kit can comprise instructions in the form of a label or separate insert (package insert) for suitable operational parameters. In yet another embodiment, the kit can comprise one or more containers with appropriate positive and negative controls or control samples, to be used as standard(s) for detection, calibration, or normalization. The kit can further comprise a second container comprising a pharmaceutically-acceptable buffer, such as (sterile) phosphate-buffered saline, Ringer's solution, or dextrose solution. It can further include other materials desirable from a commercial and user standpoint, including other buffers, diluents, filters, needles, syringes, and package inserts with instructions for use.

In certain embodiments, the kit is useful for the treatment of a subject having a disease or disorder associated with a gene set forth in Tables 3A and 3B, such as sickle cell disease or AIAD, or a regulatory sequence of a gene set forth in Table 4.

The practice of the embodiments disclosed herein employ, unless otherwise indicated, conventional techniques of immunology, biochemistry, chemistry, molecular biology, microbiology, cell biology, genomics and recombinant DNA, which are within the skill of the art. See, for example, Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G. R Taylor eds. (1995)), Harlow and Lane, eds. (1988) Antibodies, A Laboratory Manual, and Culture of Animal Cells: A Manual of Basic Technique and Specialized Applications, 6th Edition (RI. Freshney, ed. (2010)).

The following numbered additional embodiments encompassing the methods and compositions of the base editor systems and uses are envisioned herein:

1. A method of treating a disease in a subject in need thereof, comprising administering to the subject a base editor system comprising
    a guide polynucleotide or a nucleic acids encoding the guide polynucleotide;
    a polynucleotide programmable DNA binding domain or a nucleic acid encoding the polynucleotide programmable DNA binding domain, and
    an adenosine deaminase domain or a nucleic acid encoding the adenosine deaminase domain,
    wherein the guide polynucleotide is capable of targeting the base editor system to effect an A•T to G•C alteration in a HBB polynucleotide of a cell in the subject, thereby treating the disease.
2. A method of treating a disease in a subject in need thereof, comprising
    (a) introducing into a cell a base editor system comprising
        a guide polynucleotides or a nucleic acid encoding the guide polynucleotide;
        a polynucleotide programmable DNA binding domain or a nucleic acid encoding the polynucleotide programmable DNA binding domain, and
        an adenosine deaminase domain or a nucleic acid encoding the adenosine deaminase domain, and
    (b) administering the cell to the subject,
        wherein the guide polynucleotide is capable of targeting the base editor system to effect an A•T to G•C alteration in a nucleobase in a HBB polynucleotide in the cell, thereby treating the disease.
3. The method of embodiment 2, wherein the cell is a progenitor cell.
4. The method of embodiment 2 or 3, wherein the cell is a hematopoietic stem cell, a common myeloid progenitor, proerythroblast, erythroblast, reticulocyte, or erythrocyte.
5. The method of embodiment 4, wherein the hematopoietic stem cell is a CD34$^+$ cell.
6. The method of any one of embodiments 2-5, wherein the cell is autologous to the subject.
7. The method of any one of embodiments 2-5, wherein the cell is allogenic to the subject.
8. The method of any one of embodiments 2-5, wherein the cell is xenogenic to the subject.
9. The method of any one of the preceding embodiments, wherein the subject is a mammal.
10. A method of editing a HBB polynucleotide, comprising contacting the HBB polynucleotide with a base editor system comprising
    a guide polynucleotides;
    a polynucleotide programmable DNA binding domain, and
    an adenosine deaminase domain,
    wherein the guide polynucleotides is capable of targeting the base editor system to effect an A•T to G•C alteration in a nucleobase in a HBB polynucleotide.
11. A method of producing a modified cell for treatment of a disease, comprising introducing into a cell a base editor system comprising
    a guide polynucleotides or a nucleic acid encoding the guide polynucleotide;
    a polynucleotide programmable DNA binding domain or a nucleic acid encoding the polynucleotide programmable DNA binding domain, and
    an adenosine deaminase domain or a nucleic acid encoding the adenosine deaminase domain,
    wherein the guide polynucleotide is capable of targeting the base editor system to effect an A•T to G•C alteration in a nucleobase in a HBB polynucleotide in the cell.
12. The method of embodiment 11, wherein the introduction is in vivo.
13. The method of embodiment 11, wherein the introduction is ex vivo.

14. The method of embodiment 13, wherein the cell is obtained from a subject having the disease.
15. The method of any one of embodiments 11-14, wherein the cell is a mammalian cell.
16. The method of embodiment 15, wherein the cell is a progenitor cell.
17. The method of embodiment 15 or 16, wherein the cell is a hematopoietic stem cell, a common myeloid progenitor, proerythroblast, erythroblast, reticulocyte, or erythrocyte.
18. The method of embodiment 17, wherein the hematopoietic stem cell is a CD34$^+$ cell.
19. The method of any one of the preceding embodiments, wherein the polynucleotide programmable DNA binding domain is a Cas9 domain.
20. The method of embodiment 19, wherein the Cas9 domain is a nuclease inactive Cas9 domain.
21. The method of embodiment 20, wherein the Cas9 domain is a Cas9 nickase domain.
22. The method of any one of embodiments 19-21, wherein the Cas9 domain comprises a SpCas9 domain.
23. The method of embodiment 22, wherein the SpCas9 domain comprises a DIOA and/or a H840A amino acid substitution or corresponding amino acid substitutions thereof.
24. The method of embodiment 22 or 23, wherein the SpCas9 domain has specificity for a NGG PAM.
25. The method of any one of embodiments 22-24, wherein the SpCas9 domain has specificity for a NGA PAM, a NGT PAM, or a NGC PAM.
26. The method of any one of embodiments 22-25, wherein the SpCas9 domain comprises amino acid substitutions L1111R, D1135V, G1218R, E1219F, A1322R, R1335V, T1337R and one or more of L1111, D1135L, S1136R, G1218S, E1219V, D1332A, R1335Q, T1337I, T1337V, T1337F, and T1337M or corresponding amino acid substitutions thereof.
27. The method of any one of embodiments 22-25, wherein the SpCas9 domain comprises amino acid substitutions L1111R, D1135V, G1218R, E1219F, A1322R, R1335V, T1337R and one or more of L1111, D1135L, S1136R, G1218S, E1219V, D1332A, D1332S, D1332T, D1332V, D1332L, D1332K, D1332R, R1335Q, T1337I, T1337V, T1337F, T1337S, T1337N, T1337K, T1337R, T1337H, T1337Q, and T1337M or corresponding amino acid substitutions thereof.
28. The method of any one of embodiments 22-25, wherein the SpCas9 domain comprises amino acid substitutions D1135L, S1136R, G1218S, E1219V, A1322R, R1335Q, T1337, and A1322R, and one or more of 1111, D1135L, S1136R, G1218S, E1219V, D1332A, D1332S, D1332T, D1332V, D1332L, D1332K, D1332R, R1335Q, T1337I, T1337V, T1337F, T1337S, T1337N, T1337K, T1337R, T1337H, T1337Q, and T1337M or corresponding amino acid substitutions thereof.
29. The method of any one of embodiments 22-25, wherein the SpCas9 domain comprises amino acid substitutions D1135M, S1136Q, G1218K, E1219F, A1322R, D1332A, R1335E, and T1337R, or corresponding amino acid substitutions thereof.
30. The method of any one of embodiments 22-24, wherein the SpCas9 domain has specificity for a NG PAM, a NNG PAM, a GAA PAM, a GAT PAM, or a CAA PAM.
31. The method of embodiment 30, wherein the Cas9 domain comprises amino acid substitutions E480K, E543K, and E1219V or corresponding amino acid substitutions thereof.
32. The method of any one of embodiments 19-21, wherein the Cas9 domain comprises a SaCas9 domain.
33. The method of embodiment 32, wherein the SaCas9 domain has specificity for a NNNRRT PAM.
34. The method of embodiment 33, wherein the SaCas9 domain has specificity for a NNGRRT PAM.
35. The method of any one of embodiments 32-34, wherein the SaCas9 domain comprises an amino acid substitution N579A or a corresponding amino acid substitution thereof.
36. The method of any one of embodiments 32-35, wherein the SaCas9 domain comprises amino acid substitutions E782K, N968K, and R1015H, or corresponding amino acid substitutions thereof.
37. The method of any one of embodiments 19-21, wherein the Cas9 domain comprises a St1Cas9 domain.
38. The method of embodiment 37, wherein the St1Cas9 domain has specificity for a NNACCA PAM
39. The method of any one of the preceding embodiments, wherein the adenosine deaminase domain is a modified adenosine deaminase domain that does not occur in nature.
40. The method of embodiment 39, wherein the adenosine deaminase domain comprises a TadA domain.
41. The method of embodiment 36, wherein the TadA domain comprises the amino acid sequence of TadA 7.10.
42. The method of any one of the preceding embodiments, wherein the base editor system further comprises a zinc finger domain.
43. The method of embodiment 42, wherein the zinc finger domain comprises recognition helix sequences RNEHLEV (SEQ ID NO: 14), QSTTLKR (SEQ ID NO: 15), and RTEHLAR (SEQ ID NO: 16) or recognition helix sequences RGEHLRQ (SEQ ID NO: 17), QSGTLKR (SEQ ID NO: 18), and RNDKLVP (SEQ ID NO: 19).
44. The method of embodiment 42 or 43, wherein the zinc finger domain is zf1ra or zf1rb.
45. The method of any one of the preceding embodiments, wherein the base editor system further comprises a nuclear localization signal (NLS).
46. The method of any one of the preceding embodiments, wherein the base editor system further comprises one or more linkers.
47. The method of embodiment 46, wherein two or more of the polynucleotide programmable DNA binding domain, the adenosine deaminase domain, the zinc finger domain, and the NLS are connected via a linker.
48. The method of embodiment 47, wherein the linker is a peptide linker, thereby forming a base editing fusion protein.
49. The method of embodiment 48, wherein the peptide linker comprises an amino acid sequence selected from the group consisting of SGGSSGSETPGTSESAT-PESSGGS (SEQ ID NO: 64), SGGSSGGSSG-SETPGTSESATPESSGGSSGGS (SEQ ID NO: 65), GGSGGSPGSPAGSPTSTEEGTSESATPESGPGT-STEPSEGSAPGSPAGSPTSTEEGT STEPSEGSAPGTSTEPSEGSAPGTSESAT-PESGPGSEPATSGGSGGS (SEQ ID NO: 229), SGGSSGGSSGSETPGTSESATPES (SEQ ID NO: 21), SGGSSGGSSGSETPGTSESAT- PESSGGSSGGSSGGSSGGS (SEQ ID NO: 68), SGGSSGGSSGSETPGTSESAT-PESSGGSSGGSSGGSSGGSSGSETPGTSESAT-PESS GGSSGGS (SEQ ID NO: 69), PGSPAGSPT-STEEGTSESATPESGPGTSTEPSEGSAPGSPAGSPT-STEEGTSTEPSEG SAP GTSTEPSEGSAPGTSESATPESGPGSEPATS (SEQ ID NO: 70), (SGGS)n (SEQ ID NO: 49), (GGGS)n (SEQ ID NO: 163), (GGGGS)n (SEQ ID NO: 164), (G)n, (EAAAK)n (SEQ ID NO: 165), (GGS)n, SGSETPGTSESATPES (SEQ ID NO: 48), and (XP)n.

50. The method of embodiment 48 or 49, wherein the base editing fusion protein comprises the amino acid sequence selected from the group consisting of (SEQ ID NO: 22)
MPKKKRKVSEVEFSHEYWMRHALTLAKRAWDEREVPVGAVLVHNNRVIGEG

WNRPIGRHDPTAHAEIMALRQGGLVMQNYRLIDATLYVTLEPCVMCAGAMIHS

RIGRVVFGARDAKTGAAGSLMDVLHHPGMNHRVEITEGILADECAALLSDFFR

MRRQEIKAQKKAQSSTDSGGSSGGSSGSETPGTSESATPESSGGSSGGSSEVEFSH

EYWMRHALTLAKRARDEREVPVGAVLVLNNRVIGEGWNRAIGLHDPTAHAEI

MALRQGGLVMQNYRLIDATLYVTFEPCVMCAGAMIHSRIGRVVFGVRNAKTG

AAGSLMDVLHYPGMNHRVEITEGILADECAALLCYFFRMPRQVFNAQKKAQSS

TDSGGSSGGSSGSETPGTSESATPESDLVLGLAIGIGSVGVGILNKVTGEIIHKNSR

IFPAAQAENNL VRRTNRQGRRLARRKKHRRVRLNRLFEESGLITDFTKISININPY

QLRVKGLTDELSNEELFIALKNMVKHRGISYLDDASDDGNSSVGDYAQIVKENS

KQLETKTPGQIQLERYQTYGQLRGDFTVEKDGKKHRLINVFPTSAYRSEALRILQ

TQQEFNPQITDEFINRYLEILTGKRKYYHGPGNEKSRTDYGRYRTSGETLDNIFGI

LIGKCTFYPDEFRAAKASYTAQEFNLLNDLNNLTVPTETKKLSKEQKNQIINYVK

NEKAMGPAKLFKYIAKLLSCDVADIKGYRIDKSGKAEIHTFEAYRKMKTLETLDI

EQMDRETLDKLAYVLTLNTEREGIQEALEHEFADGSFSQKQVDELVQFRKANSS

IFGKGWHNFSVKLMMELIPELYETSEEQMTILTRLGKQKTTSSSNKTKYIDEKLL

TEEIYNPVVAKSVRQAIKIVNAAIKEYGDFDNIVIEMARETNEDDEKKAIQKIQK

ANKDEKDAAMLKAANQYNGKAELPHSVFHGHKQLATKIRLWHQQGERCLYTG

KTISIHDLINNSNQFEVDHILPLSITFDDSLANKVLVYATANQEKGQRTPYQALDS

MDDAWSFRELKAFVRESKTLSNKKKEYLLTEEDISKFDVRKKFIERNLVDTLYA

SRVVLNALQEHFRAHKIDTKVSVVRGQFTSQLRRHWGIEKTRDTYHHHAVDALI

IAASSQLNLWKKQKNTLVSYSEDQLLDIETGELISDDEYKESVFKAPYQHFVDTL

KSKEFEDSILFSYQVDSKFNRKISDATIYATRQAKVGKDKADETYVLGKIKDIYT

QDGYDAFMKIYKKDKSKFLMYRHDPQTFEKVIEPILENYPNKQINDKGKEVPCN

PFLKYKEEHGYIRKYSKKGNGPEIKSLKYYDSKLGNHIDITPKDSNNKVVLQSVS

PWRADVYFNKTTGKYEILGLKY ADLQFDKGTGTYKISQEKYNDIKKKEGVDSD

SEFKFTLYKNDLLLVKDTETKEQQLFRFLSRTMPKQKHYVELKPYDKQKFEGGE

ALIKVLGNVANSGQCKKGLGKSNISIYKVRTDVLGNQHIIKNEGDKPKLDFPKK

KRKVEGADKRTADGSEFESPKKKRKV, (SEQ ID NO: 28)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGSSGSETPGTSESATPESSGGSSGGSSEVEFSHEYWMRHA

LTLAKRARDEREVPVGAVLVLNNRVIGEGWNRAIGLHDPTAHAEIMALRQGGL

VMQNYRLIDATLYVTFEPCVMCAGAMIHSRIGRVVFGVRNAKTGAAGSLMDVL

-continued

```
HYPGMNHRVEITEGILADECAALLCYFFRMPRQVFNAQKKAQSSTDSGGSSGGS
SGSETPGTSESATPESSGGSSGGSSGSKRNYILGLAIGITSVGYGIIDYETRDVIDAGVR
LFKEANVENNEGRRSKRGARRLKRRRHRIQRVKKLLFDYNLLTDHSELSGINP
YEARVKGLSQKLSEEEFSAALLHLAKRRGVHNVNEVEEDTGNELSTKEQISRNS
KALEEKYVAELQLERLKKDGEVRGSINRFKTSDYVKEAKQLLKVQKAYHQLDQ
SFIDTYIDLLETRRTYYEGPGEGSPFGWKDIKEWYEMLGHCTYFPEELRSVKY
AYNADLYNALNDLNNLVITRDENEKLEYYEKFQIIENVFKQKKKPTLKQIAKEIL
VNEEDIKGYRVTSTGKPEFTNLKVYHDIKDITARKEIIENAELLDQIAKILTIYQSS
EDIQEELTNLNSELTQEEIEQISNLKGYTGTHNLSLKAINLILDELWHTNDNQIAIF
NRLKLVPKKVDLSQQKEIPTTLVDDFILSPVVKRSFIQSIKVINAIIKKYGLPNDIII
ELAREKNSKDAQKMINEMQKRNRQTNERIEEIIRTTGKENAKYLIEKIKLHDMQE
GKCLYSLEAIPLEDLLNNPFNYEVDHIIPRSVSFDNSFNNKVLVKQEENSKKGNR
TPFQYLSSSDSKISYETFKKHILNLAKGKGRISKTKKEYLLEERDINRFSVQKDFIN
RNLVDTRYATRGLMNLLRSYFRVNNLDVKVKSINGGFTSFLRRKWKFKKERNK
GYKHHAEDALIIANADFIFKEWKKLDKAKKVMENQMFEEKQAESMPEIETEQE
YKEIFITPHQIKHIKDFKDYKYSHRVDKKPNRKLINDTLYSTRKDDKGNTLIVNN
LNGLYDKDNDKLKKLINKSPEKLLMYHHDPQTYQKLKLIMEQYGDEKNPLYKY
YEETGNYLTKYSKKDNGPVIKKIKYYGNKLNAHLDITDDYPNSRNKVVVKLSLKP
YRFDVYLDNGVYKFVTVKNLDVIKKENYYEVNSKCYEEAKKLKKISNQAEFIAS
FYKNDLIKINGELYRVIGVNNDLLNRIEVNMIDITYREYLENMNDKRPPHIIKTIA
SKTQSIKKYSTDILGNLYEVKSKKHPQIIKKGEGADKRTADGSEFESPKKKRKV, (SEQ ID NO: 29)
MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFGARDA
KTGAAGSLMDVLHHPGMNHRVEITEGILADECAALLSDFFRMRRQEIKAQKKAQSSTD
SGGSSGGSSGSETPGTSESATPESSGGSSGGSSEVEFSHEYWMRHALTLAKRARDEREVP
VGAVLVLNNRVIGEGWNRAIGLHDPTAHAEIMALRQGGLVMQNYRLIDATLYVTFEPC
VMCAGAMIHSRIGRVVFGVRNAKTGAAGSLMDVLHYPGMNHRVEITEGILADECAAL
LCYFFRMPRQVFNAQKKAQSSTDSGGSSGGSSGSETPGTSESATPESSGGSSGGSKRNYI
LGLAIGITSVGYGIIDYETRDVIDAGVRLFKEANVENNEGRRSKRGARRLKRRRHRIQR
VKKLLFDYNLLTDHSELSGINPYEARVKGLSQKLSEEEFSAALLHLAKRRGVHNVNEVE
EDTGNELSTKEQISRNSKALEEKYVAELQLERLKKDGEVRGSINRFKTSDYVKEAKQLL
KVQKAYHQLDQSFIDTYIDLLETRRTYYEGPGEGSPFGWKDIKEWYEMLGHCTYFPE
ELRSVKYAYNADLYNALNDLNNLVITRDENEKLEYYEKFQIIENVFKQKKKPTLKQIAK
EILVNEEDIKGYRVTSTGKPEFTNLKVYHDIKDITARKEIIENAELLDQIAKILTIYQSSEDI
QEELTNLNSELTQEEIEQISNLKGYTGTHNLSLKAINLILDELWHTNDNQIAIFNRLKLVP
KKVDLSQQKEIPTTLVDDFILSPVVKRSFIQSIKVINAIIKKYGLPNDIIIELAREKNSKDAQ
KMINEMQKRNRQTNERIEEIIRTTGKENAKYLIEKIKLHDMQEGKCLYSLEAIPLEDLLN
NPFNYEVDHIIPRSVSFDNSFNNKVLVKQEENSKKGNRTPFQYLSSSDSKISYETFKKHIL
NLAKGKGRISKTKKEYLLEERDINRFSVQKDFINRNLVDTRYATRGLMNLLRSYFRVNN
LDVKVKSINGGFTSFLRRKWKFKKERNKGYKHHAEDALIIANADFIFKEWKKLDKAKK
```

-continued

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRNEHLEVHTRTHTGEKPFQC

RICMRNFSQSTTLKRHLRTHTGEKPFQCRICMRNFSRTEHLARHLKTHLRGSSAQ, or (SEQ ID NO: 30)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRGEHLRQHTRTHTGEKPFQC

RICMRNFSQSGTLKRHLRTHTGEKPFQCRICMRNFSRNDKLVPHLKTHLRGSSAQ.

51. The method of any one of the preceding embodiments, wherein the HBB polynucleotide comprises a pathogenic single nucleotide polymorphism (SNP) causative of the disease.
52. The method of embodiment 51, wherein the disease is sickle cell disease.
53. The method of embodiment 52, wherein the HBB polynucleotide encodes a beta subunit (HbB) of hemoglobin comprising an amino acid mutation resulted from the pathogenic SNP.
54. The method of embodiment 53, wherein the deamination results in substitution of the amino acid mutation with a benign amino acid, wherein the benign amino acid is different than a wild type amino acid of HbB.
55. The method of embodiment 53 or 54, wherein the amino acid mutation is at position 6 or a corresponding position thereof.
56. The method of embodiment 55, wherein the amino acid mutation is a glutamic acid (E) to valine (V) mutation at position 6 (E6V) or a corresponding position thereof.
57. The method of embodiment 56, wherein the deamination results in substitution of the E6V mutation with an Alanine at position 6 or a corresponding position thereof.
58. The method of embodiment 57, wherein the deamination is at position 17 or a corresponding position thereof.
59. The method of any one of the preceding embodiments, wherein the guide polynucleotide comprises two individual polynucleotides, wherein the two individual polynucleotides are two DNAs, two RNAs or a DNA and an RNA.
60. The method of any one of embodiments 1-59, wherein the guide polynucleotides comprise a crRNA and a tracrRNA, wherein the crRNA comprises a nucleic acid sequence complementary to a target sequence in the HBB polynucleotide.
61. The method of embodiment 60, wherein the target sequence comprises position 17 or a corresponding position thereof.
62. The method of embodiment 60 or 61, wherein the base editor system comprises a single guide RNA (sgRNA).
63. The method of embodiment 62, wherein the sgRNA comprises a sequence selected from the group consisting of CUUCUCCACAGGAGUCAGAU (SEQ ID NO: 5), ACUUCUCCACAGGAGUCAGAU (SEQ ID NO: 6), GACUUCUCCACAGGAGUCAGAU (SEQ ID NO: 7), GUUUUUGUACUCUCAAGAUUUA-AGUAACUGUACAACGAAACUUACACAGU UACUUAAAUCUUGCAGAAGCUA-CAAAGAUAAGGCUUCAUGCCGAAAUCAA CACCCUGUCAUUUUAUGGCAGGGUG (SEQ ID NO: 23), CUUCUCCACAGGAGUCAGAU-GUUUUUGUACUCUCAAGAUUUAAGUAACUG UACAACGAAACUUACACAGUUACUUAAAUC-UUGCAGAAGCUACAAAGAUA AGGCUU-CAUGCCGAAAUCAACACCCUGU-CAUUUUAUGGCAGGGUG (SEQ ID NO: 24), ACUUCUCCACAGGAGUCAGAUGUUUUUGUA-CUCUCAAGAUUUAAGUAACU GUA-CAACGAAACUUACACAGUUACUUAAAUC-UUGCAGAAGCUACAAAGAU AAGGCUUCAUGCCGAAAUCAACACCCUGU-CAUUUUAUGGCAGGGUG (SEQ ID NO: 25); and GACUUCUCCACAGGAGUCAGAUGUUUUU-GUACUCUCAAGAUUUAAGUAAC UGUA-CAACGAAACUUACACAGUUACUUAAAUC-UUGCAGAAGCUACAAAGA UAAGGCUUCAUGCCGAAAUCAACACCCUGU-CAUUUUAUGGCAGGGUG (SEQ ID NO: 26).
64. A method of treating sickle cell disease in a subject in need thereof, comprising
administering to the subject a base editor system comprising
a single guide RNA (sgRNA);
a fusion protein comprising an amino acid sequence selected from the group consisting of (SEQ ID NO: 22)

MPKKKRKVSEVEFSHEYWMRHALTLAKRAWDEREVPVGAVLVHNNRVIGEG

WNRPIGRHDPTAHAEIMALRQGGLVMQNYRLIDATLYVTLEPCVMCAGAMIHS

RIGRVVFGARDAKTGAAGSLMDVLHHPGMNHRVEITEGILADECAALLSDFFR

MRRQEIKAQKKAQSSTDSGGSSGGSSGSETPGTSESATPESSGGSSGGSSEVEFSH

EYWMRHALTLAKRARDEREVPVGAVLVLNNRVIGEGWNRAIGLHDPTAHAEI

MALRQGGLVMQNYRLIDATLYVTFEPCVMCAGAMIHSRIGRVVFGVRNAKTG

AAGSLMDVLHYPGMNHRVEITEGILADECAALLCYFFRMPRQVFNAQKKAQSS

TDSGGSSGGSSGSETPGTSESATPESDLVLGLAIGIGSVGVGILNKVTGEIIHKNSR

IFPAAQAENNL VRRTNRQGRRLARRKKHRRVRLNRLFEESGLITDFTKISININPY

QLRVKGLTDELSNEELFIALKNMVKHRGISYLDDASDDGNSSVGDYAQIVKENS

KQLETKTPGQIQLERYQTYGQLRGDFTVEKDGKKHRLINVFPTSAYRSEALRILQ

TQQEFNPQITDEFINRYLEILTGKRKYYHGPGNEKSRTDYGRYRTSGETLDNIFGI

LIGKCTFYPDEFRAAKASYTAQEFNLLNDLNNLTVPTETKKLSKEQKNQIINYVK

NEKAMGPAKLFKYIAKLLSCDVADIKGYRIDKSGKAEIHTFEAYRKMKTLETLDI

EQMDRETLDKLAYVLTLNTEREGIQEALEHEFADGSFSQKQVDELVQFRKANSS

-continued

IFGKGWHNFSVKLMMELIPELYETSEEQMTILTRLGKQKTTSSSNKTKYIDEKLL

TEEIYNPVVAKSVRQAIKIVNAAIKEYGDFDNIVIEMARETNEDDEKKAIQKIQK

ANKDEKDAAMLKAANQYNGKAELPHSVFHGHKQLATKIRLWHQQGERCLYTG

KTISIHDLINNSNQFEVDHILPLSITFDDSLANKVLVYATANQEKGQRTPYQALDS

MDDAWSFRELKAFVRESKTLSNKKKEYLLTEEDISKFDVRKKFIERNLVDTLYA

SRVVLNALQEHFRAHKIDTKVSVVRGQFTSQLRRHWGIEKTRDTYHHHAVDALI

IAASSQLNLWKKQKNTLVSYSEDQLLDIETGELISDDEYKESVFKAPYQHFVDTL

KSKEFEDSILFSYQVDSKFNRKISDATIYATRQAKVGKDKADETYVLGKIKDIYT

QDGYDAFMKIYKKDKSKFLMYRHDPQTFEKVIEPILENYPNKQINDKGKEVPCN

PFLKYKEEHGYIRKYSKKGNGPEIKSLKYYDSKLGNHIDITPKDSNNKVVLQSVS

PWRADVYFNKTTGKYEILGLKY ADLQFDKGTGTYKISQEKYNDIKKKEGVDSD

SEFKFTLYKNDLLLVKDTETKEQQLFRFLSRTMPKQKHYVELKPYDKQKFEGGE

ALIKVLGNVANSGQCKKGLGKSNISIYKVRTDVLGNQHIIKNEGDKPKLDFPKK

KRKVEGADKRTADGSEFESPKKKRKV, (SEQ ID NO: 28)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGSSGSETPGTSESATPESSGGSSGGSSEVEFSHEYWMRHA

LTLAKRARDEREVPVGAVLVLNNRVIGEGWNRAIGLHDPTAHAEIMALRQGGL

VMQNYRLIDATLYVTFEPCVMCAGAMIHSRIGRVVFGVRNAKTGAAGSLMDVL

HYPGMNHRVEITEGILADECAALLCYFFRMPRQVFNAQKKAQSSTDSGGSSGGS

SGSETPGTSESATPESSGGSSGGSKRNYILGLAIGITSVGYGIIDYETRDVIDAGVR

LFKEANVENNEGRRSKRGARRLKRRRRHRIQRVKKLLFDYNLLTDHSELSGINP

YEARVKGLSQKLSEEEFSAALLHLAKRRGVHNVNEVEEDTGNELSTKEQISRNS

KALEEKYVAELQLERLKKDGEVRGSINRFKTSDYVKEAKQLLKVQKAYHQLDQ

SFIDTYIDLLETRRTYYEGPGEGSPFGWKDIKEWYEMLMGHCTYFPEELRSVKY

AYNADLYNALNDLNNLVITRDENEKLEYYEKFQIIENVFKQKKKPTLKQIAKEIL

VNEEDIKGYRVTSTGKPEFTNLKVYHDIKDITARKEIIENAELLDQIAKILTIYQSS

EDIQEELTNLNSELTQEEIEQISNLKGYTGTHNLSLKAINLILDELWHTNDNQIAIF

NRLKLVPKKVDLSQQKEIPTTLVDDFILSPVVKRSFIQSIKVINAIIKKYGLPNDIII

ELAREKNSKDAQKMINEMQKRNRQTNERIEEIIRTTGKENAKYLIEKIKLHDMQE

GKCLYSLEAIPLEDLLNNPFNYEVDHIIPRSVSFDNSFNNKVLVKQEENSKKGNR

TPFQYLSSSDSKISYETFKKHILNLAKGKGRISKTKKEYLLEERDINRFSVQKDFIN

RNLVDTRYATRGLMNLLRSYFRVNNLDVKVKSINGGFTSFLRRKWKFKKERNK

GYKHHAEDALIIANADFIFKEWKKLDKAKKVMENQMFEEKQAESMPEIETEQE

YKEIFITPHQIKHIKDFKDYKYSHRVDKKPNRKLINDTLYSTRKDDKGNTLIVNN

LNGLYDKDNDKLKKLINKSPEKLLMYHHDPQTYQKLKLIMEQYGDEKNPLYKY

YEETGNYLTKYSKKDNGPVIKKIKYYGNKLNAHLDITDDYPNSRNKVVKLSLKP

-continued

```
YRFDVYLDNGVYKFVTVKNLDVIKKENYYEVNSKCYEEAKKLKKISNQAEFIAS

FYKNDLIKINGELYRVIGVNNDLLNRIEVNMIDITYREYLENMNDKRPPHIIKTIA

SKTQSIKKYSTDILGNLYEVKSKKHPQIIKKGEGADKRTADGSEFESPKKKRKV,
```

(SEQ ID NO: 29)
```
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRNEHLEVHTRTHTGEKPFQC

RICMRNFSQSTTLKRHLRTHTGEKPFQCRICMRNFSRTEHLARHLKTHLRGSSAQ, or
```

(SEQ ID NO: 30)
```
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL
```

-continued

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRGEHLRQHTRTHTGEKPFQC

RICMRNFSQSGTLKRHLRTHTGEKPFQCRICMRNFSRNDKLVPHLKTHLRGSSAQ, wherein the sgRNA is capable of targeting the base editor system to effect an A•T to G•C alteration in a HBB polynucleotide in a cell in the subject at position 17, thereby treating sickle cell disease, wherein the sgRNA comprises a sequence selected from the group consisting of CUUCUCCACAGGAGUCAGAU (SEQ ID NO: 5), ACUUCUCCACAGGAGUCAGAU (SEQ ID NO: 6), GACUUCUCCACAGGAGUCAGAU (SEQ ID NO: 7), GUUUUGUACUCUCAAGAUUUAAGUAACUGUACAACGAAACUUACACAGUUACUUAAAUCUUGCAGAAGCUACAAAGAUAAGGCUUCAUGCCGAAAUCAACACCCUGUCAUUUUAUGGCAGGGUG (SEQ ID NO: 23), CUUCUCCACAGGAGUCAGAUGUUUUGUACUCUCAAGAUUUAAGUAACUGUACAACGAAACUUACACAGUUACUUAAAUCUUGCAGAAGCUACAAAGAUAAGGCUUCAUGCCGAAAUCAACACCCUGUCAUUUUAUGGCAGGGUG (SEQ ID NO: 24), ACUUCUCCACAGGAGUCAGAUGUUUUUGUACUCUCAAGAUUUAAGUAACUGUACAACGAAACUUACACAGUUACUUAAAUCUUGCAGAAGCUACAAAGAUAAGGCUUCAUGCCGAAAUCAACACCCUGUCAUUUUAUGGCAGGGUG (SEQ ID NO: 25); and GACUUCUCCACAGGAGUCAGAUGUUUUUGUACUCUCAAGAUUUAAGUAACUGUACAACGAAACUUACACAGUUACUUAAAUCUUGCAGAAGCUACAAAGAUAAGGCUUCAUGCCGAAAUCAACACCCUGUCAUUUUAUGGCAGGGUG (SEQ ID NO: 26).

65. A method of treating sickle cell disease in a subject in need thereof, comprising
(a) introducing into a cell obtained from the subject a base editor system comprising
a single guide RNA (sgRNA)
a fusion protein comprising an amino acid sequence selected from the group consisting of (SEQ ID NO: 22)
MPKKKRKVSEVEFSHEYWMRHALTLAKRAWDEREVPVGAVLVHNNRVIGEG

WNRPIGRHDPTAHAEIMALRQGGLVMQNYRLIDATLYVTLEPCVMCAGAMIHS

RIGRVVFGARDAKTGAAGSLMDVLHHPGMNHRVEITEGILADECAALLSDFFR

MRRQEIKAQKKAQSSTDSGGSSGGSSGSETPGTSESATPESSGGSSGGSSEVEFSH

EYWMRHALTLAKRARDEREVPVGAVLVLNNRVIGEGWNRAIGLHDPTAHAEI

MALRQGGLVMQNYRLIDATLYVTFEPCVMCAGAMIHSRIGRVVFGVRNAKTG

AAGSLMDVLHYPGMNHRVEITEGILADECAALLCYFFRMPRQVFNAQKKAQSS

TDSGGSSGGSSGSETPGTSESATPESDLVLGLAIGIGSVGVGILNKVTGEIIHKNSR

IFPAAQAENNL VRRTNRQGRRLARRKKHRRVRLNRLFEESGLITDFTKISININPY

```
-continued
QLRVKGLTDELSNEELFIALKNMVKHRGISYLDDASDDGNSSVGDYAQIVKENS

KQLETKTPGQIQLERYQTYGQLRGDFTVEKDGKKHRLINVFPTSAYRSEALRILQ

TQQEFNPQITDEFINRYLEILTGKRKYYHGPGNEKSRTDYGRYRTSGETLDNIFGI

LIGKCTFYPDEFRAAKASYTAQEFNLLNDLNNLTVPTETKKLSKEQKNQIINYVK

NEKAMGPAKLFKYIAKLLSCDVADIKGYRIDKSGKAEIHTFEAYRKMKTLETLDI

EQMDRETLDKLAYVLTLNTEREGIQEALEHEFADGSFSQKQVDELVQFRKANSS

IFGKGWHNFSVKLMMELIPELYETSEEQMTILTRLGKQKTTSSSNKTKYIDEKLL

TEEIYNPVVAKSVRQAIKIVNAAIKEYGDFDNIVIEMARETNEDDEKKAIQKIQK

ANKDEKDAAMLKAANQYNGKAELPHSVFHGHKQLATKIRLWHQQGERCLYTG

KTISIHDLINNSNQFEVDHILPLSITFDDSLANKVLVYATANQEKGQRTPYQALDS

MDDAWSFRELKAFVRESKTLSNKKKEYLLTEEDISKFDVRKKFIERNLVDTLYA

SRVVLNALQEHFRAHKIDTKVSVVRGQFTSQLRRHWGIEKTRDTYHHHAVDALI

IAASSQLNLWKKQKNTLVSYSEDQLLDIETGELISDDEYKESVFKAPYQHFVDTL

KSKEFEDSILFSYQVDSKFNRKISDATIYATRQAKVGKDKADETYVLGKIKDIYT

QDGYDAFMKIYKKDKSKFLMYRHDPQTFEKVIEPILENYPNKQINDKGKEVPCN

PFLKYKEEHGYIRKYSKKGNGPEIKSLKYYDSKLGNHIDITPKDSNNKVVLQSVS

PWRADVYFNKTTGKYEILGLKY ADLQFDKGTGTYKISQEKYNDIKKKEGVDSD

SEFKFTLYKNDLLLVKDTETKEQQLFRFLSRTMPKQKHYVELKPYDKQKFEGGE

ALIKVLGNVANSGQCKKGLGKSNISIYKVRTDVLGNQHIIKNEGDKPKLDFPKK

KRKVEGADKRTADGSEFESPKKKRKV, (SEQ ID NO: 28)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGSSGSETPGTSESATPESSGGSSGGSSEVEFSHEYWMRHA

LTLAKRARDEREVPVGAVLVLNNRVIGEGWNRAIGLHDPTAHAEIMALRQGGL

VMQNYRLIDATLYVTFEPCVMCAGAMIHSRIGRVVFGVRNAKTGAAGSLMDVL

HYPGMNHRVEITEGILADECAALLCYFFRMPRQVFNAQKKAQSSTDSGGSSGGS

SGSETPGTSESATPESSGGSSGGSKRNYILGLAIGITSVGYGIIDYETRDVIDAGVR

LFKEANVENNEGRRSKRGARRLKRRRRHRIQRVKKLLFDYNLLTDHSELSGINP

YEARVKGLSQKLSEEEFSAALLHLAKRRGVHNVNEVEEDTGNELSTKEQISRNS

KALEEKYVAELQLERLKKDGEVRGSINRFKTSDYVKEAKQLLKVQKAYHQLDQ

SFIDTYIDLLETRRTYYEGPGEGSPFGWKDIKEWYEMLMGHCTYFPEELRSVKY

AYNADLYNALNDLNNLVITRDENEKLEYYEKFQIIENVFKQKKKPTLKQIAKEIL

VNEEDIKGYRVTSTGKPEFTNLKVYHDIKDITARKEIIENAELLDQIAKILTIYQSS

EDIQEELTNLNSELTQEEIEQISNLKGYTGTHNLSLKAINLILDELWHTNDNQIAIF

NRLKLVPKKVDLSQQKEIPTTLVDDFILSPVVKRSFIQSIKVINAIIKKYGLPNDIII

ELAREKNSKDAQKMINEMQKRNRQTNERIEEIIRTTGKENAKYLIEKIKLHDMQE

GKCLYSLEAIPLEDLLNNPFNYEVDHIIPRSVSFDNSFNNKVLVKQEENSKKGNR

TPFQYLSSSDSKISYETFKKHILNLAKGKGRISKTKKEYLLEERDINRFSVQKDFIN

RNLVDTRYATRGLMNLLRSYFRVNNLDVKVKSINGGFTSFLRRKWKFKKERNK
```

```
-continued
GYKHHAEDALIIANADFIFKEWKKLDKAKKVMENQMFEEKQAESMPEIETEQE

YKEIFITPHQIKHIKDFKDYKYSHRVDKKPNRKLINDTLYSTRKDDKGNTLIVNN

LNGLYDKDNDKLKKLINKSPEKLLMYHHDPQTYQKLKLIMEQYGDEKNPLYKY

YEETGNYLTKYSKKDNGPVIKKIKYYGNKLNAHLDITDDYPNSRNKVVKLSLKP

YRFDVYLDNGVYKFVTVKNLDVIKKENYYEVNSKCYEEAKKLKKISNQAEFIAS

FYKNDLIKINGELYRVIGVNNDLLNRIEVNMIDITYREYLENMNDKRPPHIIKTIA

SKTQSIKKYSTDILGNLYEVKSKKHPQIIKKGEGADKRTADGSEFESPKKKRKV, (SEQ ID NO: 29)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRNEHLEVHTRTHTGEKPFQC

RICMRNFSQSTTLKRHLRTHTGEKPFQCRICMRNFSRTEHLARHLKTHLRGSSAQ, or (SEQ ID NO: 30)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL
```

-continued

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRGEHLRQHTRTHTGEKPFQC

RICMRNFSQSGTLKRHLRTHTGEKPFQCRICMRNFSRNDKLVPHLKTHLRGSSAQ, (b) administering the cell to the subject,
wherein the sgRNA is capable of targeting the base editor system to effect an A•T to G•C alteration in a HBB polynucleotide in a cell in the subject at position 17, thereby treating sickle cell disease, wherein the sgRNA comprises a sequence selected from the group consisting of CUUCUCCACAGGAGUCAGAU (SEQ ID NO: 5), ACUUCUCCACAGGAGUCAGAU (SEQ ID NO: 6), GACUUCUCCACAGGAGUCAGAU (SEQ ID NO: 7), GUUUUUGUACUCUCAAGAUUUAAGUAACUGUACAACGAAACUUACACAGUUACUUAAAUCUUGCAGAAGCUACAAAGAUAAGGCUUCAUGCCGAAAUCAACACCCUGUCAUUUUAUGGCAGGGUG (SEQ ID NO: 23), CUUCUCCACAGGAGUCAGAUGUUUUUGUACUCUCAAGAUUUAAGUAACUGUACAACGAAACUUACACAGUUACUUAAAUCUUGCAGAAGCUACAAAGAUAAGGCUUCAUGCCGAAAUCAACACCCUGUCAUUUUAUGGCAGGGUG (SEQ ID NO: 24), ACUUCUCCACAGGAGUCAGAUGUUUUUGUACUCUCAAGAUUUAAGUAACUGUACAACGAAACUUACACAGUUACUUAAAUCUUGCAGAAGCUACAAAGAUAAGGCUUCAUGCCGAAAUCAACACCCUGUCAUUUUAUGGCAGGGUG (SEQ ID NO: 25); and GACUUCUCCACAGGAGUCAGAUGUUUUUGUACUCUCAAGAUUUAAGUAACUGUACAACGAAACUUACACAGUUACUUAAAUCUUGCAGAAGCUACAAAGAUAAGGCUUCAUGCCGAAAUCAACACCCUGUCAUUUUAUGGCAGGGUG (SEQ ID NO: 26).

66. A modified cell comprising a base editor system comprising:
a guide polynucleotide or a nucleic acid encoding the guide polynucleotide;
a polynucleotide programmable DNA binding domain or a nucleic acid encoding the polynucleotide programmable DNA binding domain, and
an adenosine deaminase domain or a nucleic acid encoding the adenosine deaminase domain,
wherein the guide polynucleotide is capable of targeting the base editor system to effect an A•T to G•C alteration in a nucleobase in a HBB polynucleotide in the cell.

67. The modified cell of embodiment 66, wherein the cell is obtained from a subject having the disease.

68. The modified cell of embodiment 66 or 67, wherein the cell is a mammalian cell.

69. The modified cell of embodiment 68, wherein the cell is a progenitor cell.

70. The modified cell of embodiment 68 or 69, wherein the cell is a hematopoietic stem cell, a common myeloid progenitor, proerythroblast, erythroblast, reticulocyte, or erythrocyte.

71. The modified cell of embodiment 70, wherein the hematopoietic stem cell is a CD34$^+$ cell.

72. The modified cell of any one of embodiments 68-71, wherein the polynucleotide programmable DNA binding domain is a Cas9 domain.

73. The modified cell of embodiment 72, wherein the Cas9 domain is a nuclease inactive Cas9 domain.

74. The method of embodiment 72, wherein the Cas9 domain is a Cas9 nickase domain.

75. The modified cell of any one of embodiments 72-74, wherein the Cas9 domain comprises a SpCas9 domain.

76. The modified cell of embodiment 75, wherein the SpCas9 domain comprises a D10A and/or a H840A amino acid substitution or corresponding amino acid substitutions thereof.

77. The modified cell of embodiment 75 or 76, wherein the SpCas9 domain has specificity for a NGG PAM.

78. The modified cell of any one of embodiments 75-77, wherein the SpCas9 domain has specificity for a NGA PAM, a NGT PAM, or a NGC PAM.

79. The modified cell of any one of embodiments 75-78, wherein the SpCas9 domain comprises amino acid substitutions L1111R, D1135V, G1218R, E1219F, A1322R, R1335V, T1337R and one or more of L1111, D1135L, S1136R, G1218S, E1219V, D1332A, R1335Q, T1337I, T1337V, T1337F, and T1337M or corresponding amino acid substitutions thereof.

80. The modified cell of any one of embodiments 75-78, wherein the SpCas9 domain comprises amino acid substitutions L1111R, D1135V, G1218R, E1219F, A1322R, R1335V, T1337R and one or more of L1111, D1135L, S1136R, G1218S, E1219V, D1332A, D1332S, D1332T, D1332V, D1332L, D1332K, D1332R, R1335Q, T1337I, T1337V, T1337F, T1337S, T1337N, T1337K, T1337R, T1337H, T1337Q, and T1337M or corresponding amino acid substitutions thereof.

81. The modified cell of any one of embodiments 75-78, wherein the SpCas9 domain comprises amino acid substitutions D1135L, S1136R, G1218S, E1219V, A1322R, R1335Q, T1337, and A1322R, and one or more of L1111, D1135L, S1136R, G1218S, E1219V, D1332A, D1332S, D1332T, D1332V, D1332L, D1332K, D1332R, R1335Q, T1337I, T1337V, T1337F, T1337S, T1337N, T1337K, T1337R, T1337H, T1337Q, and T1337M or corresponding amino acid substitutions thereof.

82. The modified cell of any one of embodiments 75-78, wherein the SpCas9 domain comprises amino acid substitutions D1135M, S1136Q, G1218K, E1219F, A1322R, D1332A, R1335E, and T1337R, or corresponding amino acid substitutions thereof.

83. The modified cell of any one of embodiments 75-76, wherein the SpCas9 domain has specificity for a NG PAM, a NNG PAM, a GAA PAM, a GAT PAM, or a CAA PAM.

84. The modified cell of embodiment 83, wherein the Cas9 domain comprises amino acid substitutions E480K, E543K, and E1219V or corresponding amino acid substitutions thereof.

85. The modified cell of any one of embodiments 72-74, wherein the Cas9 domain comprises a SaCas9 domain.

86. The modified cell of embodiment 85, wherein the SaCas9 domain has specificity for a NNNRRT PAM.

87. The modified cell of embodiment 86, wherein the SaCas9 domain has specificity for a NNGRRT PAM.

88. The modified cell of any one of embodiments 85-88, wherein the SaCas9 domain comprises an amino acid substitution N579A or a corresponding amino acid substitution thereof.

89. The modified cell of any one of embodiments 85-89, wherein the SaCas9 domain comprises amino acid substitutions E782K, N968K, and R1015H, or corresponding amino acid substitutions thereof.

90. The modified cell of any one of embodiments 72-74, wherein the Cas9 domain comprises a St1Cas9 domain.

91. The modified cell of embodiment 90, wherein the St1Cas9 domain has specificity for a NNACCA PAM 92. The modified cell of any one embodiments 66-91, wherein the adenosine deaminase domain is a modified adenosine deaminase domain that does not occur in nature.

93. The modified cell of embodiment 92, wherein the adenosine deaminase domain comprises a TadA domain.

94. The modified cell of embodiment 93, wherein the TadA domain comprises the amino acid sequence of Tad A7.10.

95. The modified cell of any one embodiments 66-94, wherein the base editor system further comprises a zinc finger domain.

96. The modified cell of embodiment 95, wherein the zinc finger domain comprises recognition helix sequences RNEHLEV (SEQ ID NO: 14), QSTTLKR (SEQ ID NO: 15), and RTEHLAR (SEQ ID NO: 16) or recognition helix sequences RGEHLRQ (SEQ ID NO: 17), QSGTLKR (SEQ ID NO: 18), and RNDKLVP (SEQ ID NO: 19).

97. The modified cell of embodiment 95 or 96, wherein the zinc finger domain is zf1ra or zf1rb.

98. The modified cell of any one of embodiments 66-97, wherein the base editor system further comprises a nuclear localization signal (NLS).

99. The modified cell of any one of embodiments 66-98, wherein the base editor system further comprises one or more linkers.

100. The modified cell of embodiment 99, wherein two or more of the polynucleotide programmable DNA binding domain, the adenosine deaminase domain, the zinc finger domain, and the NLS are connected via a linker.

101. The modified cell of embodiment 100, wherein the linker is a peptide linker, thereby forming a base editing fusion protein.

102. The modified cell of embodiment 101, wherein the peptide linker comprises an amino acid sequence selected from the group consisting of SGGSSG-SETPGTSESATPESSGGS (SEQ ID NO: 64), SGGSSGGSSGSETPGTSESATPESSGGSSGGS (SEQ ID NO: 65), GGSGGSPGSPAGSPTSTEEGTS-ESATPESGPGTSTEPSEGSAPGSPAGSPTSTEEGT STEPSEGSAPGTSTEPSEGSAPGTSESAT-PESGPGSEPATSGGSGGS (SEQ ID NO: 229), SGGSSGGSSSGSETPGTSESATPES (SEQ ID NO: 21), SGGSSGGSSSGSETPGTSESAT-PESSGGSSGGSSGGSSGGS (SEQ ID NO: 68), SGGSSGGSSGSETPGTSESAT-PESSGGSSGGSSGGSSGGSSGSETPGTSESAT-PESS GGSSGGS (SEQ ID NO: 69), PGSPAGSPT-STEEGTSESATPESGPGTSTEPSEGSAPGSPAGSPT-STEEGTSTEPSEG SAP GTSTEPSEGSAPGTSESATPESGPGSEPATS (SEQ ID NO: 70), (SGGS)n (SEQ ID NO: 49), (GGGS)n (SEQ ID NO: 163), (GGGGS)n (SEQ ID NO: 164), (G)n, (EAAAK)n (SEQ ID NO: 165), (GGS)n, SGSETPGTSESATPES (SEQ ID NO: 48), and (XP)n.

103. The modified cell of embodiment 101 or 102, wherein the base editing fusion protein comprises the amino acid sequence selected from the group consisting of (SEQ ID NO: 22)
MPKKKRKVSEVEFSHEYWMRHALTLAKRAWDEREVPVGAVLVHNNRVIGEG
WNRPIGRHDPTAHAEIMALRQGGLVMQNYRLIDATLYVTLEPCVMCAGAMIHS
RIGRVVFGARDAKTGAAGSLMDVLHHPGMNHRVEITEGILADECAALLSDFFR
MRRQEIKAQKKAQSSTDSGGSSGGSSGSETPGTSESATPESSGGSSGGSSEVEFSH
EYWMRHALTLAKRARDEREVPVGAVLVLNNRVIGEGWNRAIGLHDPTAHAEI
MALRQGGLVMQNYRLIDATLYVTFEPCVMCAGAMIHSRIGRVVFGVRNAKTG
AAGSLMDVLHYPGMNHRVEITEGILADECAALLCYFFRMPRQVFNAQKKAQSS
TDSGGSSGGSSGSETPGTSESATPESDLVLGLAIGIGSVGVGILNKVTGEIIHKNSR
IFPAAQAENNLVRRTNRQGRRLARRKKHRRVRLNRLFEESGLITDFTKISININPY
QLRVKGLTDELSNEELFIALKNMVKHRGISYLDDASDDGNSSVGDYAQIVKENS
KQLETKTPGQIQLERYQTYGQLRGDFTVEKDGKKHRLINVFPTSAYRSEALRILQ
TQQEFNPQITDEFINRYLEILTGKRKYYHGPGNEKSRTDYGRYRTSGETLDNIFGI
LIGKCTFYPDEFRAAKASYTAQEFNLLNDLNNLTVPTETKKLSKEQKNQIINYVK
NEKAMGPAKLFKYIAKLLSCDVADIKGYRIDKSGKAEIHTFEAYRKMKTLETLDI
EQMDRETLDKLAYVLTLNTEREGIQEALEHEFADGSFSQKQVDELVQFRKANSS
IFGKGWHNFSVKLMMELIPELYETSEEQMTILTRLGKQKTTSSSNKTKYIDEKLL
TEEIYNPVVAKSVRQAIKIVNAAIKEYGDFDNIVIEMARETNEDDEKKAIQKIQK
ANKDEKDAAMLKAANQYNGKAELPHSVFHGHKQLATKIRLWHQQGERCLYTG
KTISIHDLINNSNQFEVDHILPLSITFDDSLANKVLVYATANQEKGQRTPYQALDS
MDDAWSFRELKAFVRESKTLSNKKKEYLLTEEDISKFDVRKKFIERNLVDTLYA
SRVVLNALQEHFRAHKIDTKVSVVRGQFTSQLRRHWGIEKTRDTYHHHAVDALI
IAASSQLNLWKKQKNTLVSYSEDQLLDIETGELISDDEYKESVFKAPYQHFVDTL
KSKEFEDSILFSYQVDSKFNRKISDATIYATRQAKVGKDKADETYVLGKIKDIYT
QDGYDAFMKIYKKDKSKFLMYRHDPQTFEKVIEPILENYPNKQINDKGKEVPCN
PFLKYKEEHGYIRKYSKKGNGPEIKSLKYYDSKLGNHIDITPKDSNNKVVLQSVS
PWRADVYFNKTTGKYEILGLKY ADLQFDKGTGTYKISQEKYNDIKKKEGVDSD
SEFKFTLYKNDLLLVKDTETKEQQLFRFLSRTMPKQKHYVELKPYDKQKFEGGE
ALIKVLGNVANSGQCKKGLGKSNISIYKVRTDVLGNQHIIKNEGDKPKLDFPKK
KRKVEGADKRTADGSEFESPKKKRKV, (SEQ ID NO: 28)
MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARDAKTGAAGSLMDVLHHPGMNHRVEITEGILADECAALLSDFFRMRRQEIKA
QKKAQSSTDSGGSSGGSSGSETPGTSESATPESSGGSSGGSSEVEFSHEYWMRHA
LTLAKRARDEREVPVGAVLVLNNRVIGEGWNRAIGLHDPTAHAEIMALRQGGL
VMQNYRLIDATLYVTFEPCVMCAGAMIHSRIGRVVFGVRNAKTGAAGSLMDVL
HYPGMNHRVEITEGILADECAALLCYFFRMPRQVFNAQKKAQSSTDSGGSSGGS
SGSETPGTSESATPESSGGSSGGSKRNYILGLAIGITSVGYGIIDYETRDVIDAGVR
LFKEANVENNEGRRSKRGARRLKRRRRHRIQRVKKLLFDYNLLTDHSELSGINP
YEARVKGLSQKLSEEEFSAALLHLAKRRGVHNVNEVEEDTGNELSTKEQISRNS
KALEEKYVAELQLERLKKDGEVRGSINRFKTSDYVKEAKQLLKVQKAYHQLDQ

```
SFIDTYIDLLETRRTYYEGPGEGSPFGWKDIKEWYEMLMGHCTYFPEELRSVKY

AYNADLYNALNDLNNLVITRDENEKLEYYEKFQIIENVFKQKKKPTLKQIAKEIL

VNEEDIKGYRVTSTGKPEFTNLKVYHDIKDITARKEIIENAELLDQIAKILTIYQSS

EDIQEELTNLNSELTQEEIEQISNLKGYTGTHNLSLKAINLILDELWHTNDNQIAIF

NRLKLVPKKVDLSQQKEIPTTLVDDFILSPVVKRSFIQSIKVINAIIKKYGLPNDIII

ELAREKNSKDAQKMINEMQKRNRQTNERIEEIIRTTGKENAKYLIEKIKLHDMQE

GKCLYSLEAIPLEDLLNNPFNYEVDHIIPRSVSFDNSFNNKVLVKQEENSKKGNR

TPFQYLSSSDSKISYETFKKHILNLAKGKGRISKTKKEYLLEERDINRFSVQKDFIN

RNLVDTRYATRGLMNLLRSYFRVNNLDVKVKSINGGFTSFLRRKWKFKKERNK

GYKHHAEDALIIANADFIFKEWKKLDKAKKVMENQMFEEKQAESMPEIETEQE

YKEIFITPHQIKHIKDFKDYKYSHRVDKKPNRKLINDTLYSTRKDDKGNTLIVNN

LNGLYDKDNDKLKKLINKSPEKLLMYHHDPQTYQKLKLIMEQYGDEKNPLYKY

YEETGNYLTKYSKKDNGPVIKKIKYYGNKLNAHLDITDDYPNSRNKVVKLSLKP

YRFDVYLDNGVYKFVTVKNLDVIKKENYYEVNSKCYEEAKKLKKISNQAEFIAS

FYKNDLIKINGELYRVIGVNNDLLNRIEVNMIDITYREYLENMNDKRPPHIIKTIA

SKTQSIKKYSTDILGNLYEVKSKKHPQIIKKGEGADKRTADGSEFESPKKKRKV, (SEQ ID NO: 29)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI
```

-continued

```
ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRNEHLEVHTRTHTGEKPFQC

RICMRNFSQSTTLKRHLRTHTGEKPFQCRICMRNFSRTEHLARHLKTHLRGSSAQ, or (SEQ ID NO: 30)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRGEHLRQHTRTHTGEKPFQC

RICMRNFSQSGTLKRHLRTHTGEKPFQCRICMRNFSRNDKLVPHLKTHLRGSSAQ.
```

104. The modified cell of any one of embodiments 66-103, wherein the HBB polynucleotide comprises a pathogenic single nucleotide polymorphism (SNP) causative of the disease.
105. The modified cell of embodiment 104, wherein the disease is sickle cell disease.
106. The modified cell of embodiment 105, wherein the HBB polynucleotide encodes a beta subunit (HbB) of hemoglobin comprising an amino acid mutation resulted from the pathogenic SNP.
107. The modified cell of embodiment 106, wherein the deamination results in substitution of the amino acid mutation with a benign amino acid, wherein the benign amino acid is different than a wild type amino acid of HbB.
108. The modified cell of embodiment 106 or 107, wherein the amino acid mutation is at position 6 or a corresponding position thereof.
109. The modified cell of embodiment 108, wherein the amino acid mutation is a glutamic acid (E) to valine (V) mutation at position 6 (E6V) or a corresponding position thereof.
110. The modified cell of embodiment 109, wherein the deamination results in substitution of the E6V mutation with an Alanine at position 6 or a corresponding position thereof.
111. The modified cell of embodiment 110, wherein the deamination is at position 17 or a corresponding position thereof.
112. The modified cell of any one of embodiments 66-111, wherein the guide polynucleotide comprises two individual polynucleotides, wherein the two individual polynucleotides are two DNAs, two RNAs or a DNA and an RNA.

113. The modified cell of any one of embodiments 66-112, wherein the guide polynucleotides comprise a crRNA and a tracrRNA, wherein the crRNA comprises a nucleic acid sequence complementary to a target sequence in the HBB polynucleotide.

114. The modified cell of embodiment 113, wherein the target sequence comprises position 17 or a corresponding position thereof.

115. The modified cell of embodiment 113 or 114, wherein the base editor system comprises a single guide RNA (sgRNA).

116. The modified cell of embodiment 115, wherein the sgRNA comprises a sequence selected from the group consisting of CUUCUCCACAGGAGUCAGAU (SEQ ID NO: 5), ACUUCUCCACAGGAGUCAGAU (SEQ ID NO: 6), GACUUCUCCACAGGAGUCAGAU (SEQ ID NO: 7), GUUUUUGUACUCUCAAGAUUUAAGUAACUGUACAACGAAACUUACACAGUUACUUAAAUCUUGCAGAAGCUACAAAGAUAAGGCUUCAUGCCGAAAUCAACACCCUGUCAUUUUAUGGCAGGGUG (SEQ ID NO: 23), CUUCUCCACAGGAGUCAGAUGUUUUUGUACUCUCAAGAUUUAAGUAACUGUACAACGAAACUUACACAGUUACUUAAAUCUUGCAGAAGCUACAAAGAUA AGGCUUCAUGCCGAAAUCAACACCCUGUCAUUUUAUGGCAGGGUG (SEQ ID NO: 24), ACUUCUCCACAGGAGUCAGAUGUUUUUGUACUCUCAAGAUUUAAGUAACU GUACAACGAAACUUACACAGUUACUUAAAUCUUGCAGAAGCUACAAAGAU AAGGCUUCAUGCCGAAAUCAACACCCUGUCAUUUUAUGGCAGGGUG (SEQ ID NO: 25); and GACUUCUCCACAGGAGUCAGAUGUUUUUGUACUCUCAAGAUUUAAGUAAC UGUACAACGAAACUUACACAGUUACUUAAAUCUUGCAGAAGCUACAAAGA UAAGGCUUCAUGCCGAAAUCAACACCCUGUCAUUUUAUGGCAGGGUG (SEQ ID NO: 26).

117. A modified cell comprising a base editor system comprising
a single guide RNA (sgRNA),
a fusion protein comprising the amino acid sequence selected from the group consisting of (SEQ ID NO: 22)
MPKKKRKVSEVEFSHEYWMRHALTLAKRAWDEREVPVGAVLVHNNRVIGEGWNRPI

GRHDPTAHAEIMALRQGGLVMQNYRLIDATLYVTLEPCVMCAGAMIHSRIGRVVFGAR

DAKTGAAGSLMDVLHHPGMNHRVEITEGILADECAALLSDFFRMRRQEIKAQKKAQSS

TDSGGSSGGSSGSETPGTSESATPESSGGSSGGSSEVEFSHEYWMRHALTLAKRARDER

EVPVGAVLVLNNRVIGEGWNRAIGLHDPTAHAEIMALRQGGLVMQNYRLIDATLYVTF

EPCVMCAGAMIHSRIGRVVFGVRNAKTGAAGSLMDVLHYPGMNHRVEITEGILADECA

ALLCYFFRMPRQVFNAQKKAQSSTDSGGSSGGSSGSETPGTSESATPESDLVLGLAIGIG

SVGVGILNKVTGEIIHKNSRIFPAAQAENNLVRRTNRQGRRLARRKKHRRVRLNRLFEE

SGLITDFTKISINLNPYQLRVKGLTDELSNEELFIALKNMVKHRGISYLDDASDDGNSSV

GDYAQIVKENSKQLETKTPGQIQLERYQTYGQLRGDFTVEKDGKKHRLINVFPTSAYRS

EALRILQTQQEFNPQITDEFINRYLEILTGKRKYYHGPGNEKSRTDYGRYRTSGETLDNIF

GILIGKCTFYPDEFRAAKASYTAQEFNLLNDLNNLTVPTETKKLSKEQKNQIINYVKNEK

AMGPAKLFKYIAKLLSCDVADIKGYRIDKSGKAEIHTFEAYRKMKTLETLDIEQMDRET

LDKLAYVLTLNTEREGIQEALEHEFADGSFSQKQVDELVQFRKANSSIFGKGWHNFSVK

LMMELIPELYETSEEQMTILTRLGKOKTTSSSNKTKYIDEKLLTEEIYNPVVAKSVRQAI

KIVNAAIKEYGDFDNIVIEMARETNEDDEKKAIQKIQKANKDEKDAAMLKAANQYNGK

AELPHSVFHGHKQLATKIRLWHQQGERCLYTGKTISIHDLINNSNQFEVDHILPLSITFDD

SLANKVLVYATANQEKGQRTPYQALDSMDDAWSFRELKAFVRESKTLSNKKKEYLLT

EEDISKFDVRKKFIERNLVDTLYASRVVLNALQEHFRAHKIDTKVSVVRGQFTSQLRRH

WGIEKTRDTYHHHAVDALIIAASSQLNLWKKQKNTLVSYSEDQLLDIETGELISDDEYK

ESVFKAPYQHFVDTLKSKEFEDSILFSYQVDSKFNRKISDATIYATRQAKVGKDKADET

YVLGKIKDIYTQDGYDAFMKIYKKDKSKFLMYRHDPQTFEKVIEPILENYPNKQINDKG

KEVPCNPFLKYKEEHGYIRKYSKKGNGPEIKSLKYYDSKLGNHIDITPKDSNNKVVLQS

VSPWRADVYFNKTTGKYEILGLKYADLQFDKGTGTYKISQEKYNDIKKKEGVDSDSEF

KFTLYKNDLLLVKDTETKEQQLFRFLSRTMPKQKHYVELKPYDKQKFEGGEALIKVLG

-continued

NVANSGQCKKGLGKSNISIYKVRTDVLGNQHIIKNEGDKPKLDFPKKKRKVEGADKRT

ADGSEFESPKKKRKV, (SEQ ID NO: 28)

MSEVEFSHEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARDAKTGA

AGSLMDVLHHPGMNHRVEITEGILADECAALLSDFFRMRRQEIKAQKKAQSSTDSGGSS

GGSSGSETPGTSESATPESSGGSSGGSSEVEFSHEYWMRHALTLAKRARDEREVPVGAV

LVLNNRVIGEGWNRAIGLHDPTAHAEIMALRQGGLVMQNYRLIDATLYVTFEPCVMCA

GAMIHSRIGRVVFGVRNAKTGAAGSLMDVLHYPGMNHRVEITEGILADECAALLCYFF

RMPRQVFNAQKKAQSSTDSGGSSGGSSGSETPGTSESATPESSGGSSGGSKRNYILGLAI

GITSVGYGIIDYETRDVIDAGVRLFKEANVENNEGRRSKRGARRLKRRRHRIQRVKKL

LFDYNLLTDHSELSGINPYEARVKGLSQKLSEEEFSAALLHLAKRRGVHNVNEVEEDTG

NELSTKEQISRNSKALEEKYVAELQLERLKKDGEVRGSINRFKTSDYVKEAKQLLKVQK

AYHQLDQSFIDTYIDLLETRRTYYEGPGEGSPFGWKDIKEWYEMLMGHCTYFPEELRSV

KYAYNADLYNALNDLNNLVITRDENEKLEYYEKFQIIENVFKQKKKPTLKQIAKEILVN

EEDIKGYRVTSTGKPEFTNLKVYHDIKDITARKEIIENAELLDQIAKILTIYQSSEDIQEEL

TNLNSELTQEEIEQISNLKGYTGTHNLSLKAINLILDELWHTNDNQIAIFNRLKLVPKKV

DLSQQKEIPTTLVDDFILSPVVKRSFIQSIKVINAIIKKYGLPNDIIIELAREKNSKDAQKMI

NEMQKRNRQTNERIEEIIRTTGKENAKYLIEKIKLHDMQEGKCLYSLEAIPLEDLLNNPF

NYEVDHIIPRSVSFDNSFNNKVLVKQEENSKKGNRTPFQYLSSSDSKISYETFKKHILNLA

KGKGRISKTKKEYLLEERDINRFSVQKDFINRNLVDTRYATRGLMNLLRSYFRVNNLDV

KVKSINGGFTSFLRRKWKFKKERNKGYKHHAEDALIIANADFIFKEWKKLDKAKKVME

NQMFEEKQAESMPEIETEQEYKEIFITPHQIKHIKDFKDYKYSHRVDKKPNRKLINDTLY

STRKDDKGNTLIVNNLNGLYDKDNDKLKKLINKSPEKLLMYHHDPQTYQKLKLIMEQY

GDEKNPLYKYYEETGNYLTKYSKKDNGPVIKKIKYYGNKLNAHLDITDDYPNSRNKVV

KLSLKPYRFDVYLDNGVYKFVTVKNLDVIKKENYYEVNSKCYEEAKKLKKISNQAEFI

ASFYKNDLIKINGELYRVIGVNNDLLNRIEVNMIDITYREYLENMNDKRPPHIIKTIASKT

QSIKKYSTDILGNLYEVKSKKHPQIIKKGEGADKRTADGSEFESPKKKRKV, (SEQ ID NO: 29)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

-continued

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRNEHLEVHTRTHTGEKPFQC

RICMRNFSQSTTLKRHLRTHTGEKPFQCRICMRNFSRTEHLARHLKTHLRGSSAQ, or (SEQ ID NO: 30)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

-continued

```
ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRGEHLRQHTRTHTGEKPFQC

RICMRNFSQSGTLKRHLRTHTGEKPFQCRICMRNFSRNDKLVPHLKTHLRGSSAQ,
``` wherein the sgRNA is capable of targeting the base editor system to effect an A•T to G•C alteration in a HBB polynucleotide in the cell at position 17, wherein the sgRNA comprises a sequence selected from the group consisting of CUUCUCCACAGGA-GUCAGAU (SEQ ID NO: 5), ACUUCUCCACAG-GAGUCAGAU (SEQ ID NO: 6), GACUUCUC-CACAGGAGUCAGAU (SEQ ID NO: 7), GUUUUUGUACUCUCAAGAUUUA-AGUAACUGUACAACGAAACUUACACAGU UACUUAAAUCUUGCAGAAGCUA-CAAAGAUAAGGCUUCAUGCCGAAAUCAA CACCCUGUCAUUUUAUGGCAGGGUG (SEQ ID NO: 23), CUUCUCCACAGGAGUCAGAU-GUUUUUGUACUCUCAAGAUUUA-AGUAACUG UACAACGAAACUUA-CACAGUUACUUAAAUCUUGCAGAAGCU-ACAAAGAUA AGGCUUCAUGCCGAAAU-CAACACCCUGUCAUUUUAUGGCAGGGUG (SEQ ID NO: 24), ACUUCUCCACAGGAGU-CAGAUGUUUUUGUACUCUCAAGAUUUA-AGUAACU GUACAACGAAACUUA-CACAGUUACUUAAAUCUUGCAGAAGCUA-CAAAGAU AAGGCUUCAUGCCGAAAU-CAACACCCUGUCAUUUUAUGGCAGGGUG (SEQ ID NO: 25); and GACUUCUCCACAGGA-GUCAGAUGUUUUUGUACUCU-CAAGAUUUAAGUAAC UGUACAACGAAAC-UUACACAGUUACUUAAAUCUUGCAGAAGCUA-CAAAGA UAAGGCUUCAUGCCGAAAUCAACACCCU-GUCAUUUUAUGGCAGGGUG (SEQ ID NO: 26), wherein the cell is a red blood cell.

118. A base editor system comprising:
a guide polynucleotide or a nucleic acid encoding the guide polynucleotide;
a polynucleotide programmable DNA binding domain or a nucleic acid encoding the polynucleotide programmable DNA binding domain, and
an adenosine deaminase domain or a nucleic acid encoding the adenosine deaminase domain,
wherein the guide polynucleotide is capable of targeting the base editor system to effect an A•T to G•C alteration in a nucleobase in a HBB polynucleotide.

119. The base editor system of embodiment 118, wherein the polynucleotide programmable DNA binding domain is a Cas9 domain.

120. The modified cell of embodiment 119, wherein the Cas9 domain is a nuclease inactive Cas9 domain.

121. The base editor system of embodiment 119, wherein the Cas9 domain is a Cas9 nickase domain.

122. The base editor system of any one of embodiments 119-121, wherein the Cas9 domain comprises a SpCas9 domain.

123. The base editor system of embodiment 122, wherein the SpCas9 domain comprises a D10A and/or a H840A amino acid substitution or corresponding amino acid substitutions thereof.

124. The base editor system of embodiment 122 or 123, wherein the SpCas9 domain has specificity for a NGG PAM.

125. The base editor system of any one of embodiments 122-124, wherein the SpCas9 domain has specificity for a NGA PAM, a NGT PAM, or a NGC PAM.

126. The base editor system of any one of embodiments 122-125, wherein the SpCas9 domain comprises amino acid substitutions L1111R, D1135V, G1218R, E1219F, A1322R, R1335V, T1337R and one or more of L1111, D1135L, S1136R, G1218S, E1219V, D1332A, R1335Q, T1337I, T1337V, T1337F, and T1337M or corresponding amino acid substitutions thereof.

127. The base editor system of any one of embodiments 122-125, wherein the SpCas9 domain comprises amino acid substitutions L1111R, D1135V, G1218R, E1219F, A1322R, R1335V, T1337R and one or more of L1111, D1135L, S1136R, G1218S, E1219V, D1332A, D1332S, D1332T, D1332V, D1332L, D1332K, D1332R, R1335Q, T1337I, T1337V, T1337F, T1337S, T1337N, T1337K, T1337R, T1337H, T1337Q, and T1337M or corresponding amino acid substitutions thereof.

128. The base editor system of any one of embodiments 122-125, wherein the SpCas9 domain comprises amino acid substitutions D1135L, S1136R, G1218S, E1219V, A1322R, R1335Q, T1337, and A1322R, and one or more of L1111, D1135L, S1136R, G1218S, E1219V, D1332A, D1332S, D1332T, D1332V, D1332L, D1332K, D1332R, R1335Q, T1337I, T1337V, T1337F, T1337S, T1337N, T1337K, T1337R, T1337H, T1337Q, and T1337M or corresponding amino acid substitutions thereof.

129. The base editor system of any one of embodiments 122-125, wherein the SpCas9 domain comprises amino acid substitutions D1135M, S1136Q, G1218K, E1219F, A1322R, D1332A, R1335E, and T1337R, or corresponding amino acid substitutions thereof.

130. The base editor system of any one of embodiments 122-123, wherein the SpCas9 domain has specificity for a NG PAM, a NNG PAM, a GAA PAM, a GAT PAM, or a CAA PAM.

131. The base editor system of embodiment 130, wherein the Cas9 domain comprises amino acid substitutions E480K, E543K, and E1219V or corresponding amino acid substitutions thereof.

132. The base editor system of any one of embodiments 119-121, wherein the Cas9 domain comprises a SaCas9 domain.

133. The base editor system of embodiment 132, wherein the SaCas9 domain has specificity for a NNNRRT PAM.

134. The base editor system of embodiment 133, wherein the SaCas9 domain has specificity for a NNGRRT PAM.

135. The base editor system of any one of embodiments 132-134, wherein the SaCas9 domain comprises an amino acid substitution N579A or a corresponding amino acid substitution thereof.

136. The base editor system of any one of embodiments 134-135, wherein the SaCas9 domain comprises amino acid substitutions E782K, N968K, and R1015H, or corresponding amino acid substitutions thereof.
137. The base editor system of any one of embodiments 119-121, wherein the Cas9 domain comprises a St1Cas9 domain.
138. The base editor system of embodiment 137, wherein the St1Cas9 domain has specificity for a NNACCA PAM
139. The base editor system of any one of embodiments 118-138, wherein the adenosine deaminase domain is a modified adenosine deaminase domain that does not occur in nature.
140. The base editor system of embodiment 139, wherein the adenosine deaminase domain comprises a TadA domain.
141. The base editor system of embodiment 140, wherein the TadA domain comprises the amino acid sequence of TadA 7.10.
142. The base editor system of any one embodiments 118-138, wherein the base editor system further comprises a zinc finger domain.
143. The base editor system of embodiment 142, wherein the zinc finger domain comprises recognition helix sequences RNEHLEV (SEQ ID NO: 14), QSTTLKR (SEQ ID NO: 15), and RTEHLAR (SEQ ID NO: 16) or recognition helix sequences RGEHLRQ (SEQ ID NO: 17), QSGTLKR (SEQ ID NO: 18), and RNDKLVP (SEQ ID NO: 19).
144. The base editor system of embodiment 142 or 143, wherein the zinc finger domain is zf1ra or zf1rb.
145. The base editor system of any one of embodiments 118-138, wherein the base editor system further comprises a nuclear localization signal (NLS).
146. The base editor system of any one of embodiments 118-145, wherein the base editor system further comprises one or more linkers.
147. The base editor system of embodiment 146, wherein two or more of the polynucleotide programmable DNA binding domain, the adenosine deaminase domain, the zinc finger domain, and the NLS are connected via a linker.
148. The base editor system of embodiment 147, wherein the linker is a peptide linker, thereby forming a base editing fusion protein.
149. The base editor system of embodiment 148, wherein the peptide linker comprises an amino acid sequence selected from the group consisting of

```
                                              (SEQ ID NO: 64)
SGGSSGSETPGTSESATPESSGGS, (SEQ ID NO: 65)
SGGSSGGSSGSETPGTSESATPESSGGSSGGS, (SEQ ID NO: 229)
GGSGGSPGSPAGSPTSTEEGTSESATPESGPGTSTEPSEGSAPGSPAGS
PTSTEEGTSTEPSEGSAPGTSTEPSEGSAPGTSESATPESGPGSEPATS
GGSGGS,
                                              (SEQ ID NO: 21)
SGGSSGGSSGSETPGTSESATPES, (SEQ ID NO: 68)
SGGSSGGSSGSETPGTSESATPESSGGSSGGSSGGSSGGS, (SEQ ID NO: 69)
SGGSSGGSSGSETPGTSESATPESSGGSSGGSSGGSSGGSSGSETPGTS
ESATPESSGGSSGGS, (SEQ ID NO: 70)
PGSPAGSPTSTEEGTSESATPESGPGTSTEPSEGSAPGSPAGSPTSTEE
GTSTEPSEGSAP GTSTEPSEGSAPGTSESATPESGPGSEPATS, (SEQ ID NO: 49)
(SGGS)n, (SEQ ID NO: 163)
(GGGS)n , (SEQ ID NO: 164)
(GGGGS)n, (SEQ ID NO: 165)
(G)n, (EAAAK)n, (SEQ ID NO: 48)
(GGS)n, SGSETPGTSESATPES, and (XP)n.
```

150. The base editor system of embodiment 148 or 149, wherein the base editing fusion protein comprises the amino acid sequence selected from the group consisting of

```
                                              (SEQ ID NO: 22)
MPKKKRKVSEVEFSHEYWMRHALTLAKRAWDEREVPVGAVLVHNNRVIGEG

WNRPIGRHDPTAHAEIMALRQGGLVMQNYRLIDATLYVTLEPCVMCAGAMIHS

RIGRVVFGARDAKTGAAGSLMDVLHHPGMNHRVEITEGILADECAALLSDFFR

MRRQEIKAQKKAQSSTDSGGSSGGSSGSETPGTSESATPESSGGSSGGSSEVEFSH

EYWMRHALTLAKRARDEREVPVGAVLVLNNRVIGEGWNRAIGLHDPTAHAEI

MALRQGGLVMQNYRLIDATLYVTFEPCVMCAGAMIHSRIGRVVFGVRNAKTG

AAGSLMDVLHYPGMNHRVEITEGILADECAALLCYFFRMPRQVFNAQKKAQSS

TDSGGSSGGSSGSETPGTSESATPESDLVLGLAIGIGSVGVGILNKVTGEIIHKNSR

IFPAAQAENNLVRRTNRQGRRLARRKKHRRVRLNRLFEESGLITDFTKISININPY

QLRVKGLTDELSNEELFIALKNMVKHRGISYLDDASDDGNSSVGDYAQIVKENS

KQLETKTPGQIQLERYQTYGQLRGDFTVEKDGKKHRLINVFPTSAYRSEALRILQ

TQQEFNPQITDEFINRYLEILTGKRKYYHGPGNEKSRTDYGRYRTSGETLDNIFGI
```

```
LIGKCTFYPDEFRAAKASYTAQEFNLLNDLNNLTVPTETKKLSKEQKNQIINYVK

NEKAMGPAKLFKYIAKLLSCDVADIKGYRIDKSGKAEIHTFEAYRKMKTLETLDI

EQMDRETLDKLAYVLTLNTEREGIQEALEHEFADGSFSQKQVDELVQFRKANSS

IFGKGWHNFSVKLMMELIPELYETSEEQMTILTRLGKQKTTSSSNKTKYIDEKLL

TEEIYNPVVAKSVRQAIKIVNAAIKEYGDFDNIVIEMARETNEDDEKKAIQKIQK

ANKDEKDAAMLKAANQYNGKAELPHSVFHGHKQLATKIRLWHQQGERCLYTG

KTISIHDLINNSNQFEVDHILPLSITFDDSLANKVLVYATANQEKGQRTPYQALDS

MDDAWSFRELKAFVRESKTLSNKKKEYLLTEEDISKFDVRKKFIERNLVDTLYA

SRVVLNALQEHFRAHKIDTKVSVVRGQFTSQLRRHWGIEKTRDTYHHHAVDALI

IAASSQLNLWKKQKNTLVSYSEDQLLDIETGELISDDEYKESVFKAPYQHFVDTL

KSKEFEDSILFSYQVDSKFNRKISDATIYATRQAKVGKDKADETYVLGKIKDIYT

QDGYDAFMKIYKKDKSKFLMYRHDPQTFEKVIEPILENYPNKQINDKGKEVPCN

PFLKYKEEHGYIRKYSKKGNGPEIKSLKYYDSKLGNHIDITPKDSNNKVVLQSVS

PWRADVYFNKTTGKYEILGLKY ADLQFDKGTGTYKISQEKYNDIKKKEGVDSD

SEFKFTLYKNDLLLVKDTETKEQQLFRFLSRTMPKQKHYVELKPYDKQKFEGGE

ALIKVLGNVANSGQCKKGLGKSNISIYKVRTDVLGNQHIIKNEGDKPKLDFPKK

KRKVEGADKRTADGSEFESPKKKRKV, (SEQ ID NO: 28)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGSSGSETPGTSESATPESSGGSSGGSSEVEFSHEYWMRHA

LTLAKRARDEREVPVGAVLVLNNRVIGEGWNRAIGLHDPTAHAEIMALRQGGL

VMQNYRLIDATLYVTFEPCVMCAGAMIHSRIGRVVFGVRNAKTGAAGSLMDVL

HYPGMNHRVEITEGILADECAALLCYFFRMPRQVFNAQKKAQSSTDSGGSSGGS

SGSETPGTSESATPESSGGSSGGSKRNYILGLAIGITSVGYGIIDYETRDVIDAGVR

LFKEANVENNEGRRSKRGARRLKRRRRHRIQRVKKLLFDYNLLTDHSELSGINP

YEARVKGLSQKLSEEEFSAALLHLAKRRGVHNVNEVEEDTGNELSTKEQISRNS

KALEEKYVAELQLERLKKDGEVRGSINRFKTSDYVKEAKQLLKVQKAYHQLDQ

SFIDTYIDLLETRRTYYEGPGEGSPFGWKDIKEWYEMLMGHCTYFPEELRSVKY

AYNADLYNALNDLNNLVITRDENEKLEYYEKFQIIENVFKQKKKPTLKQIAKEIL

VNEEDIKGYRVTSTGKPEFTNLKVYHDIKDITARKEIIENAELLDQIAKILTIYQSS

EDIQEELTNLNSELTQEEIEQISNLKGYTGTHNLSLKAINLILDELWHTNDNQIAIF

NRLKLVPKKVDLSQQKEIPTTLVDDFILSPVVKRSFIQSIKVINAIIKKYGLPNDIII

ELAREKNSKDAQKMINEMQKRNRQTNERIEEIIRTTGKENAKYLIEKIKLHDMQE

GKCLYSLEAIPLEDLLNNPFNYEVDHIIPRSVSFDNSFNNKVLVKQEENSKKGNR

TPFQYLSSSDSKISYETFKKHILNLAKGKGRISKTKKEYLLEERDINRFSVQKDFIN

RNLVDTRYATRGLMNLLRSYFRVNNLDVKVKSINGGFTSFLRRKWKFKKERNK

GYKHHAEDALIIANADFIFKEWKKLDKAKKVMENQMFEEKQAESMPEIETEQE

YKEIFITPHQIKHIKDFKDYKYSHRVDKKPNRKLINDTLYSTRKDDKGNTLIVNN

LNGLYDKDNDKLKKLINKSPEKLLMYHHDPQTYQKLKLIMEQYGDEKNPLYKY
```

-continued

YEETGNYLTKYSKKDNGPVIKKIKYYGNKLNAHLDITDDYPNSRNKVVKLSLKP

YRFDVYLDNGVYKFVTVKNLDVIKKENYYEVNSKCYEEAKKLKKISNQAEFIAS

FYKNDLIKINGELYRVIGVNNDLLNRIEVNMIDITYREYLENMNDKRPPHIIKTIA

SKTQSIKKYSTDILGNLYEVKSKKHPQIIKKGEGADKRTADGSEFESPKKKRKV, (SEQ ID NO: 29)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRNEHLEVHTRTHTGEKPFQC

RICMRNFSQSTTLKRHLRTHTGEKPFQCRICMRNFSRTEHLARHLKTHLRGSSAQ, or (SEQ ID NO: 30)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRRHRIQR

-continued

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRGEHLRQHTRTHTGEKPFQC

RICMRNFSQSGTLKRHLRTHTGEKPFQCRICMRNFSRNDKLVPHLKTHLRGSSAQ.

151. The base editor system of any one of embodiments 118-150, wherein the HBB polynucleotide comprises a pathogenic single nucleotide polymorphism (SNP) causative of the disease.
152. The base editor system of embodiment 151, wherein the disease is sickle cell disease.
153. The base editor system of embodiment 152, wherein the HBB polynucleotide encodes a beta subunit (HbB) of hemoglobin comprising an amino acid mutation resulted from the pathogenic SNP.
154. The base editor system of embodiment 153, wherein the deamination results in substitution of the amino acid mutation with a benign amino acid, wherein the benign amino acid is different than a wild type amino acid of HbB.
155. The base editor system of embodiment 153 or 154, wherein the amino acid mutation is at position 6 or a corresponding position thereof.
156. The base editor system of embodiment 155, wherein the amino acid mutation is a glutamic acid (E) to valine (V) mutation at position 6 (E6V) or a corresponding position thereof.
157. The base editor system of embodiment 156, wherein the deamination results in substitution of the E6V mutation with an Alanine at position or a corresponding position thereof.
158. The base editor system of embodiment 157, wherein the deamination is at position 17 or a corresponding position thereof.
159. The base editor system of any one of embodiments 118-158, wherein the guide polynucleotide comprises two individual polynucleotides, wherein the two individual polynucleotides are two DNAs, two RNAs or a DNA and an RNA.
160. The base editor system of any one of embodiments 118-159, wherein the guide polynucleotides comprise a crRNA and a tracrRNA, wherein the crRNA comprises a nucleic acid sequence complementary to a target sequence in the HBB polynucleotide.
161. The base editor system of embodiment 160, wherein the target sequence comprises position 17 or a corresponding position thereof.
162. The base editor system of embodiment 160 or 161, wherein the base editor system comprises a single guide RNA (sgRNA).
163. The base editor system of embodiment 162, wherein the sgRNA comprises a sequence selected from the group consisting of CUUCUCCACAGGAGUCAGAU (SEQ ID NO: 5), ACUUCUCCACAGGAGUCAGAU (SEQ ID NO: 6), GACUUCUCCACAGGAGUCAGAU (SEQ ID NO: 7), GUUUUUGUACUCUCAAGAUUUAAGUAACUGUACAACGAAACUUACACAGU UACUUAAAUCUUGCAGAAGCUACAAAGAUAAGGCUUCAUGCCGAAAUCAA CACCCUGUCAUUUUAUGGCAGGGUG (SEQ ID NO: 23), CUUCUCCACAGGAGUCAGAUGUUUUUGUACUCUCAAGAUUUAAGUAACUG UACAACGAAACUUACACAGUUACUUAAAUCUUGCAGAAGCUACAAAGAUA AGGCUUCAUGCCGAAAUCAACACCCUGUCAUUUUAUGGCAGGGUG (SEQ ID NO: 24), ACUUCUCCACAGGAGUCAGAUGUUUUUGUACUCUCAAGAUUUAAGUAACU GUACAACGAAACUUACACAGUUACUUAAAUCUUGCAGAAGCUACAAAGAU AAGGCUUCAUGCCGAAAUCAACACCCUGU-
CAUUUUAUGGCAGGGUG (SEQ ID NO: 25); and
GACUUCUCCACAGGAGUCAGAUGUUUUU-
GUACUCUCAAGAUUUAAGUAAC UGUA-
CAACGAAACUUACACAGUUACUUAAAUC-
UUGCAGAAGCUACAAAGA

UAAGGCUUCAUGCCGAAAUCAACACCCUGU-
CAUUUUAUGGCAGGGUG (SEQ ID NO: 26).

164. A base editor system comprising:
  a single guide RNA (sgRNA),
  a fusion protein comprising the amino acid sequence selected from the group consisting of (SEQ ID NO: 22)
MPKKKRKVSEVEFSHEYWMRHALTLAKRAWDEREVPVGAVLVHNNRVIGEG

WNRPIGRHDPTAHAEIMALRQGGLVMQNYRLIDATLYVTLEPCVMCAGAMIHS

RIGRVVFGARDAKTGAAGSLMDVLHHPGMNHRVEITEGILADECAALLSDFFR

MRRQEIKAQKKAQSSTDSGGSSGGSSGSETPGTSESATPESSGGSSGGSSEVEFSH

EYWMRHALTLAKRARDEREVPVGAVLVLNNRVIGEGWNRAIGLHDPTAHAEI

MALRQGGLVMQNYRLIDATLYVTFEPCVMCAGAMIHSRIGRVVFGVRNAKTG

AAGSLMDVLHYPGMNHRVEITEGILADECAALLCYFFRMPRQVFNAQKKAQSS

TDSGGSSGGSSGSETPGTSESATPESDLVLGLAIGIGSVGVGILNKVTGEIIHKNSR

IFPAAQAENNL VRRTNRQGRRLARRKKHRRVRLNRLFEESGLITDFTKISININPY

QLRVKGLTDELSNEELFIALKNMVKHRGISYLDDASDDGNSSVGDYAQIVKENS

KQLETKTPGQIQLERYQTYGQLRGDFTVEKDGKKHRLINVFPTSAYRSEALRILQ

TQQEFNPQITDEFINRYLEILTGKRKYYHGPGNEKSRTDYGRYRTSGETLDNIFGI

LIGKCTFYPDEFRAAKASYTAQEFNLLNDLNNLTVPTETKKLSKEQKNQIINYVK

NEKAMGPAKLFKYIAKLLSCDVADIKGYRIDKSGKAEIHTFEAYRKMKTLETLDI

EQMDRETLDKLAYVLTLNTEREGIQEALEHEFADGSFSQKQVDELVQFRKANSS

IFGKGWHNFSVKLMMELIPELYETSEEQMTILTRLGKQKTTSSSNKTKYIDEKLL

TEEIYNPVVAKSVRQAIKIVNAAIKEYGDFDNIVIEMARETNEDDEKKAIQKIQK

ANKDEKDAAMLKAANQYNGKAELPHSVFHGHKQLATKIRLWHQQGERCLYTG

KTISIHDLINNSNQFEVDHILPLSITFDDSLANKVLVYATANQEKGQRTPYQALDS

MDDAWSFRELKAFVRESKTLSNKKKEYLLTEEDISKFDVRKKFIERNLVDTLYA

SRVVLNALQEHFRAHKIDTKVSVVRGQFTSQLRRHWGIEKTRDTYHHHAVDALI

IAASSQLNLWKKQKNTLVSYSEDQLLDIETGELISDDEYKESVFKAPYQHFVDTL

KSKEFEDSILFSYQVDSKFNRKISDATIYATRQAKVGKDKADETYVLGKIKDIYT

QDGYDAFMKIYKKDKSKFLMYRHDPQTFEKVIEPILENYPNKQINDKGKEVPCN

PFLKYKEEHGYIRKYSKKGNGPEIKSLKYYDSKLGNHIDITPKDSNNKVVLQSVS

PWRADVYFNKTTGKYEILGLKY ADLQFDKGTGTYKISQEKYNDIKKKEGVDSD

SEFKFTLYKNDLLLVKDTETKEQQLFRFLSRTMPKQKHYVELKPYDKQKFEGGE

ALIKVLGNVANSGQCKKGLGKSNISIYKVRTDVLGNQHIIKNEGDKPKLDFPKK

KRKVEGADKRTADGSEFESPKKKRKV, (SEQ ID NO: 28)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGSSGSETPGTSESATPESSGGSSGGSSEVEFSHEYWMRHA

LTLAKRARDEREVPVGAVLVLNNRVIGEGWNRAIGLHDPTAHAEIMALRQGGL

VMQNYRLIDATLYVTFEPCVMCAGAMIHSRIGRVVFGVRNAKTGAAGSLMDVL

HYPGMNHRVEITEGILADECAALLCYFFRMPRQVFNAQKKAQSSTDSGGSSGGS

-continued

```
SGSETPGTSESATPESSGGSSGGSKRNYILGLAIGITSVGYGIIDYETRDVIDAGVR

LFKEANVENNEGRRSKRGARRLKRRRRHRIQRVKKLLFDYNLLTDHSELSGINP

YEARVKGLSQKLSEEEFSAALLHLAKRRGVHNVNEVEEDTGNELSTKEQISRNS

KALEEKYVAELQLERLKKDGEVRGSINRFKTSDYVKEAKQLLKVQKAYHQLDQ

SFIDTYIDLLETRRTYYEGPGEGSPFGWKDIKEWYEMLMGHCTYFPEELRSVKY

AYNADLYNALNDLNNLVITRDENEKLEYYEKFQIIENVFKQKKKPTLKQIAKEIL

VNEEDIKGYRVTSTGKPEFTNLKVYHDIKDITARKEIIENAELLDQIAKILTIYQSS

EDIQEELTNLNSELTQEEIEQISNLKGYTGTHNLSLKAINLILDELWHTNDNQIAIF

NRLKLVPKKVDLSQQKEIPTTLVDDFILSPVVKRSFIQSIKVINAIIKKYGLPNDIII

ELAREKNSKDAQKMINEMQKRNRQTNERIEEIIRTTGKENAKYLIEKIKLHDMQE

GKCLYSLEAIPLEDLLNNPFNYEVDHIIPRSVSFDNSFNNKVLVKQEENSKKGNR

TPFQYLSSSDSKISYETFKKHILNLAKGKGRISKTKKEYLLEERDINRFSVQKDFIN

RNLVDTRYATRGLMNLLRSYFRVNNLDVKVKSINGGFTSFLRRKWKFKKERNK

GYKHHAEDALIIANADFIFKEWKKLDKAKKVMENQMFEEKQAESMPEIETEQE

YKEIFITPHQIKHIKDFKDYKYSHRVDKKPNRKLINDTLYSTRKDDKGNTLIVNN

LNGLYDKDNDKLKKLINKSPEKLLMYHHDPQTYQKLKLIMEQYGDEKNPLYKY

YEETGNYLTKYSKKDNGPVIKKIKYYGNKLNAHLDITDDYPNSRNKVVKLSLKP

YRFDVYLDNGVYKFVTVKNLDVIKKENYYEVNSKCYEEAKKLKKISNQAEFIAS

FYKNDLIKINGELYRVIGVNNDLLNRIEVNMIDITYREYLENMNDKRPPHIIKTIA

SKTQSIKKYSTDILGNLYEVKSKKHPQIIKKGEGADKRTADGSEFESPKKKRKV, (SEQ ID NO: 29)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND
```

-continued

```
TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRNEHLEVHTRTHTGEKPFQC

RICMRNFSQSTTLKRHLRTHTGEKPFQCRICMRNFSRTEHLARHLKTHLRGSSAQ, or (SEQ ID NO: 30)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENMNDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRGEHLRQHTRTHTGEKPFQC

RICMRNFSQSGTLKRHLRTHTGEKPFQCRICMRNFSRNDKLVPHLKTHLRGSSAQ.
``` wherein the sgRNA is capable of targeting the base editor system to effect an A•T to G•C alteration in a HBB polynucleotide in the cell at position 17, wherein the sgRNA comprises a sequence selected from the group consisting of (SEQ ID NO: 5)
CUUCUCCACAGGAGUCAGAU, (SEQ ID NO: 6)
ACUUCUCCACAGGAGUCAGAU, (SEQ ID NO 7)
GACUUCUCCACAGGAGUCAGAU, (SEQ ID NO: 23)
GUUUUUGUACUCUCAAGAUUUAAGUAACUGUACAACGAAACUUACACAG

UUACUUAAAUCUUGCAGAAGCUACAAAGAUAAGGCUUCAUGCCGAAAUC

AACACCCUGUCAUUUUAUGGCAGGGUG, (SEQ ID NO: 24)
CUUCUCCACAGGAGUCAGAUGUUUUUGUACUCUCAAGAUUUAAGUAACU

GUACAACGAAACUUACACAGUUACUUAAAUCUUGCAGAAGCUACAAAGA

UAAGGCUUCAUGCCGAAAUCAACACCCUGUCAUUUUAUGGCAGGGUG, (SEQ ID NO: 25)
ACUUCUCCACAGGAGUCAGAUGUUUUUGUACUCUCAAGAUUUAAGUAAC

UGUACAACGAAACUUACACAGUUACUUAAAUCUUGCAGAAGCUACAAAG

AUAAGGCUUCAUGCCGAAAUCAACACCCUGUCAUUUUAUGGCAGGGUG; and (SEQ ID NO: 26)
GACUUCUCCACAGGAGUCAGAUGUUUUUGUACUCUCAAGAUUUAAGUAA

CUGUACAACGAAACUUACACAGUUACUUAAAUCUUGCAGAAGCUACAAA

GAUAAGGCUUCAUGCCGAAAUCAACACCCUGUCAUUUUAUGGCAGGGUG.

165. A method of treating a disease in a subject in need thereof, comprising administering to the subject a base editor system comprising
a guide polynucleotide or a nucleic acid encoding the guide polynucleotide;
a polynucleotide programmable DNA binding domain or a nucleic acid encoding the polynucleotide programmable DNA binding domain, and
a deaminase domain or a nucleic acid encoding the deaminase domain,
wherein the guide polynucleotides is capable of targeting the base editor system to effect deamination of a nucleobase in a target polynucleotide of a cell in the subject,
wherein the target polynucleotide encodes a protein comprising a pathogenic amino acid causative of the disease, wherein the deamination results in substitution of the pathogenic amino acid with a benign amino acid, thereby treating the disease,
wherein the benign amino acid is different than a wild type amino acid of the protein.

166. A method of treating a disease in a subject in need thereof, comprising
(a) introducing into a cell a base editor system comprising
a guide polynucleotide or a nucleic acid encoding the guide polynucleotide;
a polynucleotide programmable DNA binding domain or a nucleic acid encoding the polynucleotide programmable DNA binding domain, and
a deaminase domain or a nucleic acid encoding the deaminase domain,
(b) administering the cell to the subject,
wherein the guide polynucleotides is capable of targeting the base editor system to effect deamination of a nucleobase in a target polynucleotide of a cell in the subject,
wherein the target polynucleotide encodes a protein comprising a pathogenic amino acid causative of the disease, wherein the deamination results in substitution of the pathogenic amino acid with a benign amino acid, thereby treating the disease,
wherein the benign amino acid is different than a wild type amino acid of the protein.

167. A method of producing a modified cell for treatment of a disease, comprising introducing into a cell a base editor system comprising
a guide polynucleotides or a nucleic acid encoding the guide polynucleotide;
a polynucleotide programmable DNA binding domain or a nucleic acid encoding the polynucleotide programmable DNA binding domain, and
a deaminase domain or a nucleic acid encoding the deaminase domain,
wherein the guide polynucleotides is capable of targeting the base editor system to effect deamination of a nucleobase in a target polynucleotide in the cell,
wherein the target polynucleotide encodes a protein comprising a pathogenic amino acid causative of a disease, wherein the deamination results in substitution of the pathogenic amino acid with a benign amino acid, wherein the benign amino acid is different than a wild type amino acid of the protein.

168. The method of embodiment 167, wherein the introduction is in vivo or ex vivo.

169. The method of embodiment 167 or 168, wherein the cell is a mammalian cell.

170. The method of any one of embodiments 164-169, wherein the target polynucleotide comprises a pathogenic single nucleotide polymorphism (SNP) causative of the pathogenic amino acid.

171. The method of embodiment 170, wherein the disease is MCAD deficiency, sickle cell disease, a hemoglobin disease, beta-thalassemia, Pendred syndrome, a familial Parkinson's disease, or alpha-1 antitrypsin deficiency (A1AD).

172. The method of any one of embodiments 164-171, wherein the deamination of the nucleobase modifies expression, activity, or stability of the protein.

173. The method of embodiment 172, wherein the deamination of the nucleobase increases expression, activity, or stability of the protein.

174. The method of any one of embodiments 164-173, wherein the target polynucleotide is a ACADM polynucleotide and the protein is a MCAD protein.

175. The method of embodiment 174, wherein the deamination results in an amino acid substitution K329E>K329G amino acid change in the MCAD protein.

176. The method of any one of embodiments 164-173, wherein the target polynucleotide is a HBB polynucleotide and the protein is a beta subunit (HbB) of hemoglobin.

177. The method of embodiment 176, wherein the deamination results in an amino acid substitution E26K>E26G in the HbB.

178. The method of any one of embodiments 164-173, wherein the target polynucleotide is a PDS polynucleotide and the protein is a Pendrin.
179. The method of embodiment 178, wherein the deamination results in an amino acid substitution T416P>T416F in the Pendrin.
180. The method of any one of embodiments 164-173, wherein the target polynucleotide is a SCNA polynucleotide and the protein is an alpha synuclein protein.
181. The method of embodiment 180, wherein the deamination results in an amino acid substitution A30P>A30L in the alpha synuclein protein.
182. The method of any one of embodiments 164-173, wherein the gene is a SERPINA1 polynucleotide and the protein is an A1AT protein.
183. The method of embodiment 182, wherein the deamination results in an amino acid substitution E342K>E342G in the A1AT protein.
184. The method of any one of embodiments 164-183, wherein the polynucleotide programmable DNA binding domain is a Cas9 domain.
185. The method of embodiment 184, wherein the Cas9 domain is a nuclease inactive Cas9 domain or a Cas9 nickase domain.
186. The method of embodiment 184 or 185, wherein the Cas9 domain comprises a SpCas9 domain.
187. The method of embodiment 186, wherein the SpCas9 domain comprises a D10A and/or a H840A amino acid substitution or corresponding amino acid substitutions thereof.
188. The method of embodiment 186 or 187, wherein the SpCas9 domain has specificity for a NGN PAM.
189. The method of any one of embodiments 186-188, wherein the SpCas9 domain comprises amino acid substitutions D1135M, S1136Q, G1218K, E1219F, A1322R, D1332A, R1335E, and T1337R, or corresponding amino acid substitutions thereof.
190. The method of embodiment 184 or 185, wherein the Cas9 domain comprises a SaCas9 domain.
191. The method of embodiment 190, wherein the SaCas9 domain has specificity for a NNNRRT PAM.
192. The method of embodiment 190 or 191, wherein the SaCas9 domain comprises an amino acid substitution N579A or a corresponding amino acid substitution thereof.
193. The method of any one of embodiments 190-192, wherein the SaCas9 domain comprises amino acid substitutions E782K, N968K, and R1015H, or corresponding amino acid substitutions thereof.
194. The method of embodiment 184 or 185, wherein the Cas9 domain comprises a St1Cas9 domain.
195. The method of embodiment 194, wherein the Cas9 domain has specificity for a NNACCA PAM.
196. The method of any one of embodiments 164-195, wherein the deaminase domain comprises a cytidine deaminase domain.
197. The method of embodiment 196, wherein the cytidine deaminase domain comprises an APOBEC1 domain.
198. The method of any one of embodiments 164-195, wherein the deaminase domain comprises an adenosine deaminase domain.
199. The method of embodiment 198, wherein the adenosine deaminase domain comprises a TadA domain comprising the amino acid sequence of TADA 7.10.
200. The method of any one of embodiments 164-199, wherein the base editor system further comprises a UGI domain.
201. The method of any one of embodiments 164-200, wherein the base editor system further comprises one or more linkers.
202. The method of embodiment 201, wherein two or more of the polynucleotide programmable DNA binding domain, the deaminase domain, and the UGI domain are connected via a linker.
203. The method of embodiment 202, wherein the linker is a peptide linker, thereby forming a base editing fusion protein.
204. The method of embodiment 203, wherein the base editing fusion protein comprises the amino acid sequence of BE4.
205. The method of embodiment 203, wherein the base editing fusion protein comprises the amino acid sequence of TadA 7.10.
206. A base editor system for treatment of a disease, comprising
a guide polynucleotides or a nucleic acid encoding the guide polynucleotide;
a polynucleotide programmable DNA binding domain or a nucleic acid encoding the polynucleotide programmable DNA binding domain, and
a deaminase domain or a nucleic acid encoding the deaminase domain,
wherein the guide polynucleotides is capable of targeting the base editor system to effect deamination of a nucleobase in a target polynucleotide,
wherein the target polynucleotide comprises a targeting sequence listed in Table 2,
wherein the target polynucleotide encodes a protein comprising a pathogenic amino acid causative of a disease, wherein the deamination results in substitution of the pathogenic amino acid with a benign amino acid,
wherein the benign amino acid is different than a wild type amino acid of the protein.
207. A method of treating a disease in a subject in need thereof, comprising administering to the subject a base editor system comprising
a guide polynucleotide or a nucleic acid encoding the guide polynucleotide;
a polynucleotide programmable DNA binding domain or a nucleic acid encoding the polynucleotide programmable DNA binding domain, and
a deaminase domain or a nucleic acid encoding the deaminase domain,
wherein the guide polynucleotides is capable of targeting the base editor system to effect deamination of a nucleobase in a target polynucleotide of a cell in the subject, thereby treating the disease,
wherein the nucleobase is in a regulatory element of a gene.
208. A method of treating a disease in a subject in need thereof, comprising
(a) introducing into a cell a base editor system comprising
a guide polynucleotide or a nucleic acid encoding the guide polynucleotide;
a polynucleotide programmable DNA binding domain or a nucleic acid encoding the polynucleotide programmable DNA binding domain, and
a deaminase domain or a nucleic acid encoding the deaminase domain, (b) administering the cell to the subject,
wherein the guide polynucleotides is capable of targeting the base editor system to effect deamination of a nucleobase in a target polynucleotide of the cell, thereby treating the disease, wherein the nucleobase is in a regulatory element of a gene.

209. A method of producing a modified cell for treatment of a disease, comprising introducing into a cell a base editor system comprising
a guide polynucleotides or a nucleic acid encoding the guide polynucleotide;
a polynucleotide programmable DNA binding domain or a nucleic acid encoding the polynucleotide programmable DNA binding domain, and
a deaminase domain or a nucleic acid encoding the deaminase domain,
wherein the guide polynucleotides is capable of targeting the base editor system to effect deamination of a nucleobase in a target polynucleotide of the cell, wherein the nucleobase is in a regulatory element of a gene.

210. The method of embodiment 209, wherein the introduction is in vivo or ex vivo.
211. The method embodiment 209 or 210, wherein the cell is a mammalian cell.
212. The method of embodiment 211, wherein the cell is a CD34+ cell.
213. The method of any one of embodiments 207-212, wherein the gene is associated with the disease.
214. The method of embodiment 213, wherein expression, activity, or processing of the gene is causative of the disease.
215. The method of any one of embodiments 207-214, wherein the deamination modifies expression, activity, or processing of the gene.
216. The method of any one of embodiments 207-215, wherein the deamination alters a binding pattern of at least one protein to the regulatory element.
217. The method of any one of embodiments 207-216, wherein the regulatory element is a promoter, an enhancer, a repressor, a silencer, an insulator, a start codon, a stop codon, Kozak consensus sequence, a splice acceptor, a splice donor, a splice site, a 3' untranslated region (UTR), a 5' untranslated region (UTR), or an intergenic region of the gene.
218. The method of any one of embodiments 207-218, wherein the deamination results in removal of a splice site, a start codon, stop codon, or Kozak consensus sequence.
219. The method of any one of embodiments 207-218, wherein the deamination results in addition of a splice site, a start codon, stop codon, or Kozak consensus sequence.
220. The method of any one of embodiments 207-218, wherein the deamination results in an intron inclusion.
221. The method of any one of embodiments 207-218, wherein the deamination results in an exon skipping.
222. The method of any one of embodiments 207-221, wherein the deamination is in a regulatory element of a gene selected from any one of the genes listed in Table 2.
223. The method of embodiment 222, wherein the disease is Hereditary Persistence of Fetal Hemoglobin (HPFH).
224. The method of embodiment 223, wherein the gene is HBG1 or HBG2.
225. The method of embodiment 224, wherein the target polynucleotide comprises a sequence selected from the group consisting of TCCACAGGAGTCAGATGCAC (SEQ ID NO: 230), TGAAGAGGTGTCCTCAGTCTA (SEQ ID NO: 231), TCTGAAGAGGTGTCCTCAGTCT (SEQ ID NO: 232), and TGGTAAGGCCCTGGGCAGGT (SEQ ID NO: 233), or any complement thereof.
226. The method of any one of embodiments 207-225, wherein the polynucleotide programmable DNA binding domain is a Cas9 domain.
227. The method of embodiment 226, wherein the Cas9 domain is a nuclease inactive Cas9 domain or a Cas9 nickase domain.
228. The method of embodiment 226 or 227, wherein the Cas9 domain comprises a SpCas9 domain.
229. The method of embodiment 228, wherein the SpCas9 domain comprises a D10A and/or a H840A amino acid substitution or corresponding amino acid substitutions thereof.
230. The method of embodiment 228 or 229, wherein the SpCas9 domain has specificity for a NGN PAM.
231. The method of embodiment any one of embodiments 228-230, wherein the SpCas9 domain comprises amino acid substitutions D1135M, S1136Q, G1218K, E1219F, A1322R, D1332A, R1335E, and T1337R, or corresponding amino acid substitutions thereof.
232. The method of embodiment 226 or 227, wherein the Cas9 domain comprises a SaCas9 domain.
233. The method of embodiment 232, wherein the SaCas9 domain has specificity for a NNNRRT PAM.
234. The method of embodiment 232 or 233, wherein the SaCas9 domain comprises an amino acid substitution N579A or a corresponding amino acid substitution thereof.
235. The method of any one of embodiments 232-234, wherein the SaCas9 domain comprises amino acid substitutions E782K, N968K, and R1015H, or corresponding amino acid substitutions thereof.
236. The method of embodiment 226 or 227, wherein the Cas9 domain comprises a St1Cas9 domain.
237. The method of embodiment 236, wherein the Cas9 domain has specificity for a NNACCA PAM.
238. The method of any one of embodiments 207-237, wherein the deaminase domain comprises a cytidine deaminase domain.
239. The method of embodiment 238, wherein the cytidine deaminase domain comprises an APOBEC1 domain.
240. The method of any one of embodiments 207-237, wherein the deaminase domain comprises an adenosine deaminase domain.
241. The method of embodiment 240, wherein the adenosine deaminase domain comprises a TadA domain comprising the amino acid sequence of TadA 7.10.
242. The method of any one of embodiments 207-41, wherein the base editor system further comprises a UGI domain.
243. The method of any one of embodiments 207-242, wherein the base editor system further comprises one or more linkers.
244. The method of embodiment 244, wherein two or more of the polynucleotide programmable DNA binding domain, the deaminase domain, and the UGI domain are connected via a linker.
245. The method of embodiment 244, wherein the linker is a peptide linker, thereby forming a base editing fusion protein.

246. The method of embodiment 245, wherein the base editing fusion protein comprises the amino acid sequence of BE4.

247. The method of embodiment 245, wherein the base editing fusion protein comprises the amino acid sequence of BE4.

248. A base editor system comprising
a guide polynucleotides or a nucleic acid encoding the guide polynucleotide;
a polynucleotide programmable DNA binding domain or a nucleic acid encoding the polynucleotide programmable DNA binding domain, and
a deaminase domain or a nucleic acid encoding the deaminase domain,
wherein the guide polynucleotides is capable of targeting the base editor system to effect deamination of a nucleobase in a target polynucleotide,
wherein the target polynucleotide comprises a targeting sequence listed in Table 3A or Table 3B,
wherein the nucleobase is in a regulatory element of a gene listed in Table 3A or Table 3B.

EXAMPLES

The following examples are provided for illustrative purposes only and are not intended to limit the scope of the claims provided herein.

Example 1. PAM Variant Validation in Base Editors

Novel CRISPR systems and PAM variants enable the base editors to make precise corrections at target SNPs. Several novel PAM variants have been evaluated and validated. Details of PAM evaluations and base editors are described, for example, in International PCT Application Nos. PCT/2017/045381 (WO2018/027078) and PCT/US2016/058344 (WO2017/070632), each of which is incorporated herein by reference in its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of each of which are hereby incorporated by reference.

Example 2. Gene Editing to Correct Alpha-1 Antitrypsin Deficiency (A1AD)

Figure 2:
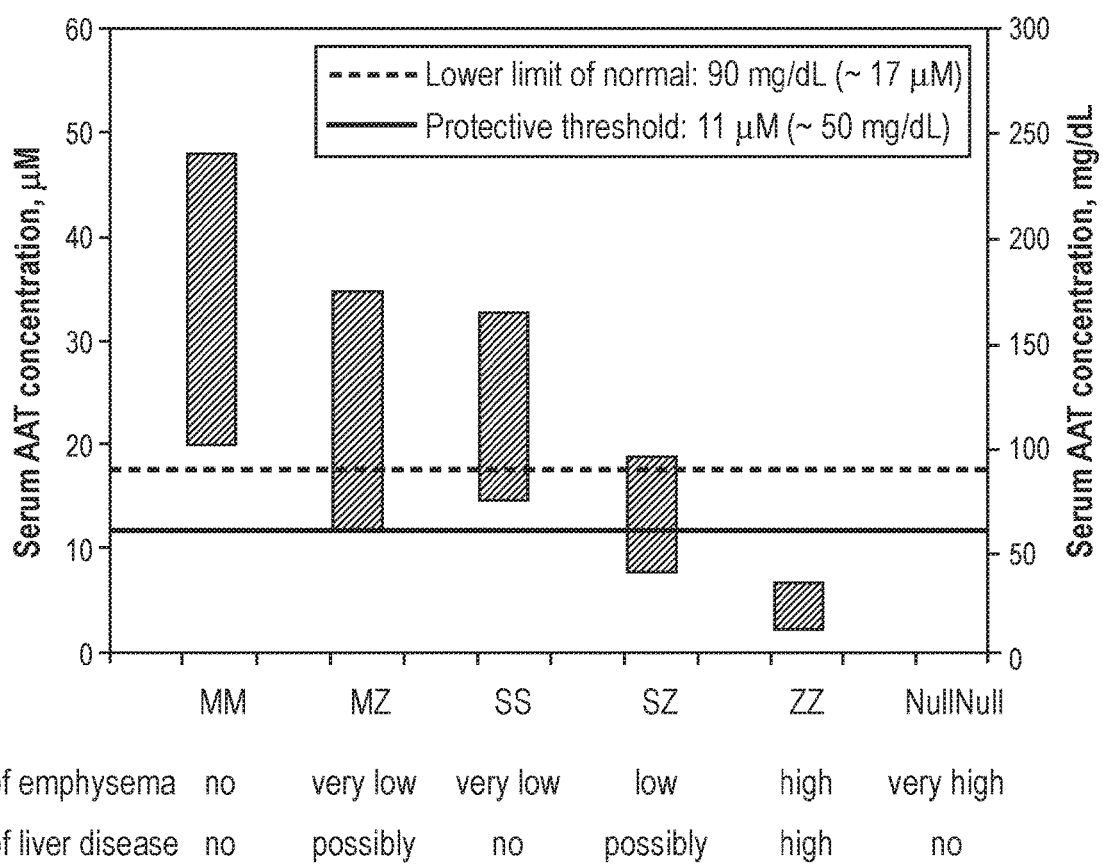
FIG. 2 shows typical ranges of serum alpha-1 antitrypsin (A1AT) levels for different genotypes (normal (MM); heterozygous carriers of alpha-1 antitrypsin deficiency (MZ, SZ); and homozygous deficiency (SS, ZZ)). Serum alpha-1 antitrypsin (AAT) concentration is expressed in µM in the left "y" axis, which is common in the literature. The right "y" axis shows an approximate conversion of serum AAT concentration into mg/dL units, as commonly reported by clinical laboratories and by different measurement technologies (nephelometry or radial immunodiffusion).

Alpha-1 antitrypsin (A1A) is a protease inhibitor encoded by the SERPINA1 gene on chromosome 14. This glycoprotein is synthesized mainly in the liver and is secreted into the blood, with serum concentrations of 1.5-3.0 g/L (20-52 μmol/L) in healthy adults (FIG. 1). It diffuses into the lung interstitium and alveolar lining fluid, where it inactivates neutrophil elastase, thereby protecting the lung tissue from protease-mediated damage. Alpha-1 antitrypsin deficiency is inherited in an autosomal codominant fashion. Over 100 genetic variants of the SERPINA1 gene have been described, but not all are associated with disease. The alphabetic designation of these variants is based on their speed of migration on gel electrophoresis. The most common variant is the M (medium mobility) allele, and the two most frequent deficiency alleles are PiS and PiZ (the latter having the slowest rate of migration). Several mutations have been described that produce no measurable serum protein; these are referred to as "null" alleles. The most common genotype is MM, which produces normal serum levels of alpha-1 antitrypsin. Most people with severe deficiency are homozygous for the Z allele (ZZ). The Z protein misfolds and polymerizes during its production in the endoplasmic reticulum of hepatocytes; these abnormal polymers are trapped in the liver, greatly reducing the serum levels of alpha-1 antitrypsin. The liver disease seen in patients with alpha-1 antitrypsin deficiency is caused by the accumulation of abnormal alpha-1 antitrypsin protein in hepatocytes and the consequent cellular responses, including autophagy, the endoplasmic reticulum stress response and apoptosis. FIG. 2 shows the most common genotypes and the respective serum levels of alpha-1 antitrypsin. Reduced circulating levels of alpha-1 antitrypsin lead to increased neutrophil elastase activity in the lungs; this imbalance of protease and antiprotease results in the lung disease associated with this condition (FIG. 1).

Alpha-1 antitrypsin deficiency ("A1AD") is most common in caucasians, and the disorder most frequently affects the lungs and liver of an afflicted individual. In the lungs, the most common manifestation is early-onset (patients in their 30s and 40s) panacinar emphysema most pronounced in the lung bases. However, diffuse or upper lobe emphysema can occur, as can bronchiectasis. The most frequently described symptoms include dyspnea, wheezing and cough. Pulmonary function testing shows findings consistent with COPD; however, bronchodilator responsiveness can be seen and can be labelled as asthma.

Liver disease caused by the ZZ genotype manifests in various ways. Affected infants can present in the newborn period with cholestatic jaundice, sometimes with alcoholic stools (pale or clay-coloured) and hepatomegaly. Conjugated bilirubin, transaminases and gamma-glutamyl transferase levels in blood are elevated. Liver disease in older children and adults can present with an incidental finding of elevated transaminases or with signs of established cirrhosis, including variceal hemorrhage or ascites. Alpha-1 antitrypsin deficiency also predisposes patients to hepatocellular carcinoma. Although the homozygous ZZ genotype is necessary for liver disease to develop, a heterozygous Z mutation can act as a genetic modifier for other diseases by conferring a greater risk of more severe liver disease, such as in hepatitis C infection and cystic fibrosis liver disease.

The two most common clinical variants of A1AD are the E264V (PiS) and the E342K (PiZ) alleles. More than half of A1AD patients harbor at least one copy of the E342K allelic mutation. Nuclease genome editing via HDR is inefficient and the abundant indels can lower circulating levels and worsen lung symptoms. Gene therapy involving transducing liver cells using AAV vectors worsens liver pathology due to the production of further misfolded protein. AAVs encoding both wild-type A1AT and siRNA that knocks down E342K A1AT show promise for addressing both pathologies.

A strategy for a correcting a mutation in the SERPINA1 gene which encodes A1AT using base editing as described herein is shown in FIG. 3. Using the base editing system described herein in which mRNA+gRNA transfection an ABE having an SpCas9 DNA binding domain evolved and engineered to accept NGC PAMs (ngcABE), nucleobases A5/A7 in the SERPINA1 nucleic acid sequence were edited to introduce D341G. Nucleobases A7/A8 in the SERPINA1 nucleic acid sequence were edited to introduce E342G. Different correction strategies for the E342K variant using an ABE or REPAIR (RNA editing) yielded a mixture of products: D341G, E342G, E342R, K343E, and K343G. As shown in FIG. 4, for A1AT protein function, the D341G off-target edit was benign on its own, but deleterious in combination with E342K. E342G restored A1AT function. E342R was non-functional.

Table 8 below presents a representative list of wild-type and variant (E342K) SERPINA1-encoded amino acid sequences and open reading frame (ORF) nucleic acid sequences of the wild-type and variant (E342K) SERPINA1 polynucleotides.

TABLE 8

Exemplary Sequences

| | SEQ ID NO | Sequences |
|---|---|---|
| SERPINA1 Amino acids | 1 | MPSSVSWGILLLAGLCCLVPVSLAEDPQGDAAQKTDTSHEDQDHPTFN KITPNLAEFAFSLYRQLAHQSNSTNIFFSPVSIATAFAMLSLGTKADTHD EILEGLNFNLTEIPEAQIHEGFQELLRTLNQPDSQLQLTTGNGLFLSEGLK LVDKFLEDVKKLYHSEAFTVNFGDTEEAKKQINDYVEKGTQGKIVDLV KELDRDTVFALVNYIFFKGKWERPFEVKDTEEEDFHVDQVTTVKVPM MKRLGMFNIQHCKKLSSWVLLMKYLGNATAIFFLPDEGKLQHLENELT HDIITKFLENEDRRSASLHLPKLSITGTYDLKSVLGQLGITKVFSNGADL SGVTEEAPLKLSKAVHKAVLTIDEKGTEAAGAMFLEAIPMSIPPEVKFN KPFVFLMIEQNTKSPLFMGKVVNPTQK |
| SERPINA1 ORF | 2 | ATGCCGTCTTCTGTCTCGTGGGGCATCCTCCTGCTGGCAGGCCTGTG CTGCCTGGTCCCTGTCTCCCTGGCTGAGGATCCCCAGGGAGATGCTG CCCAGAAGACAGATACATCCCACCATGATCAGGATCACCCAACCTT CAACAAGATCACCCCCAACCTGGCTGAGTTCGCCTTCAGCCTATACC GCCAGCTGGCACACCAGTCCAACAGCACCAATATCTTCTTCTCCCCA GTGAGCATCGCTACAGCCTTTGCAATGCTCTCCCTGGGGACCAAGGC TGACACTCACGATGAAATCCTGGAGGGCCTGAATTTCAACCTCACG GAGATTCCGGAGGCTCAGATCCATGAAGGCTTCCAGGAACTCCTCC GTACCCTCAACCAGCCAGACAGCCAGCTCCAGCTGACCACCGGCAA TGGCCTGTTCCTCAGCGAGGGCCTGAAGCTAGTGGATAAGTTTTTGG AGGATGTTAAAAAGTTGTACCACTCAGAAGCCTTCACTGTCAACTTC GGGGACACCGAAGAGGCCAAGAAACAGATCAACGATTACGTGGAG AAGGGTACTCAAGGGAAAATTGTGGATTTGGTCAAGGAGCTTGACA GAGACACAGTTTTTGCTCTGGTGAATTACATCTTCTTTAAAGGCAAA TGGGAGAGACCCTTTGAAGTCAAGGACACCGAGGAAGAGGACTTCC ACGTGGACCAGGTGACCACCGTGAAGGTGCCTATGATGAAGCGTTT AGGCATGTTTAACATCCAGCACTGTAAGAAGCTGTCCAGCTGGGTG CTGCTGATGAAATACCTGGGCAATGCCACCGCCATCTTCTTCCTGCC TGATGAGGGGAAACTACAGCACCTGGAAAATGAACTCACCCACGAT ATCATCACCAAGTTCCTGGAAAATGAAGACAGAAGGTCTGCCAGCT TACATTTACCCAAACTGTCCATTACTGGAACCTATGATCTGAAGAGC GTCCTGGGTCAACTGGGCATCACTAAGGTCTTCAGCAATGGGGCTG ACCTCTCCGGGGTCACAGAGGAGGCACCCCTGAAGCTCTCCAAGGC CGTGCATAAGGCTGTGCTGACCATCGACGAGAAGGGACTGAAGCT GCTGGGGCATGTTTTTAGAGGCATACCCATGTCTATCCCCCCCGA GGTCAAGTTCAACAAACCCTTTGTCTTCTTAATGATTGAACAAAATA CCAAGTCTCCCCTCTTCATGGGAAAAGTGGTGAATCCCACCCAAAA A |
| SERPINA1 E342K Amino Acids | 3 | MPSSVSWGILLLAGLCCLVPVSLAEDPQGDAAQKTDTSHEDQDHPTFN KITPNLAEFAFSLYRQLAHQSNSTNIFFSPVSIATAFAMLSLGTKADTHD EILEGLNFNLTEIPEAQIHEGFQELLRTLNQPDSQLQLTTGNGLFLSEGLK LVDKFLEDVKKLYHSEAFTVNFGDTEEAKKQINDYVEKGTQGKIVDLV KELDRDTVFALVNYIFFKGKWERPFEVKDTEEEDFHVDQVTTVKVPM MKRLGMFNIQHCKKLSSWVLLMKYLGNATAIFFLPDEGKLQHLENELT HDIITKFLENEDRRSASLHLPKLSITGTYDLKSVLGQLGITKVFSNGADL SGVTEEAPLKLSKAVHKAVLTIDKKGTEAAGAMFLEAIPMSIPPEVKFN KPFVFLMIEQNTKSPLFMGKVVNPTQK |
| SERPINA1 E342K ORF | 4 | ATGCCGTCTTCTGTCTCGTGGGGCATCCTCCTGCTGGCAGGCCTGTG CTGCCTGGTCCCTGTCTCCCTGGCTGAGGATCCCCAGGGAGATGCTG CCCAGAAGACAGATACATCCCACCATGATCAGGATCACCCAACCTT CAACAAGATCACCCCCAACCTGGCTGAGTTCGCCTTCAGCCTATACC GCCAGCTGGCACACCAGTCCAACAGCACCAATATCTTCTTCTCCCCA GTGAGCATCGCTACAGCCTTTGCAATGCTCTCCCTGGGGACCAAGGC TGACACTCACGATGAAATCCTGGAGGGCCTGAATTTCAACCTCACG GAGATTCCGGAGGCTCAGATCCATGAAGGCTTCCAGGAACTCCTCC GTACCCTCAACCAGCCAGACAGCCAGCTCCAGCTGACCACCGGCAA TGGCCTGTTCCTCAGCGAGGGCCTGAAGCTAGTGGATAAGTTTTTGG AGGATGTTAAAAAGTTGTACCACTCAGAAGCCTTCACTGTCAACTTC GGGGACACCGAAGAGGCCAAGAAACAGATCAACGATTACGTGGAG AAGGGTACTCAAGGGAAAATTGTGGATTTGGTCAAGGAGCTTGACA GAGACACAGTTTTTGCTCTGGTGAATTACATCTTCTTTAAAGGCAAA TGGGAGAGACCCTTTGAAGTCAAGGACACCGAGGAAGAGGACTTCC ACGTGGACCAGGTGACCACCGTGAAGGTGCCTATGATGAAGCGTTT AGGCATGTTTAACATCCAGCACTGTAAGAAGCTGTCCAGCTGGGTG CTGCTGATGAAATACCTGGGCAATGCCACCGCCATCTTCTTCCTGCC TGATGAGGGGAAACTACAGCACCTGGAAAATGAACTCACCCACGAT |

TABLE 8-continued

Exemplary Sequences

| SEQ ID NO | Sequences |
|---|---|
| | ATCATCACCAAGTTCCTGGAAAATGAAGACAGAAGGTCTGCCAGCT<br>TACATTTACCCAAACTGTCCATTACTGGAACCTATGATCTGAAGAGC<br>GTCCTGGGTCAACTGGGCATCACTAAGGTCTTCAGCAATGGGGCTG<br>ACCTCTCCGGGGTCACAGAGGAGGCACCCCTGAAGCTCTCCAAGGC<br>CGTGCATAAGGCTGTGCTGACCATCGACaAGAAAGGGACTGAAGCT<br>GCTGGGGCCATGTTTTTAGAGGCCATACCCATGTCTATCCCCCCCGA<br>GGTCAAGTTCAACAAACCCTTTGTCTTCTTAATGATTGAACAAAATA<br>CCAAGTCTCCCCTCTTCATGGGAAAAGTGGTGAATCCCACCCAAAA<br>A |

Example 3. Gene Editing at the Sickle Cell Disease Site in the HBB Gene

An A-to-G nucleobase editor (BE) was constructed and comprise a modified *Staphylococcus aureus* Cas9 (SaCas9 KKH) nucleic acid programmable DNA binding domain that accepts NNNRRT PAMs and heterodimer of wild-type TadA and TadA7.10 (ABE SaCas9 KKH). SaCas9 KKH, which contains the amino acid substitutions E782K/N968K/R1015H relative to wild-type SaCas9 (Kleinstiver et al. Nat Biotechnol., 2015; 33(12): 1293-1298), was identified as having nuclease activity at NNNRRT PAMs based on site-depletion assays. The TadA7.10 domain has adenosine deaminase activity on adenine in DNA, and the *S. aureus* nCas9 (D10A) domain has nickase activity. For use in eukaryotic genome editing, the ABE SaCas9 KKH includes a nuclear localization signal at its C-terminus. The amino acid sequence of ABE SaCas9 KKH is provided below (wtTadA underlined-a.a. linker italics-TadA*7.10 underlined-amino acid linker italics-SaCas9 KKH-a.a. linker italics-NLS bold italics):

(SEQ ID NO: 28)
MSEVEFSHEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARDAKTGA

AGSLMDVLHHPGMNHRVEITEGILADECAALLSDFFRMRRQEIKAQKKAQSSTD*SGGSS*

*GGSSGSETPGTSESATPESSGGSSGGS*EVEFSHEYWMRHALTLAKRARDEREVPVGAVL

VLNNRVIGEGWNRAIGLHDPTAHAEEVIALRQGGLVMQNYRLIDATLYVTFEPCVMCA

GAMIHSRIGRVVFGVRNAKTGAAGSLMDVLHYPGMNHRVEITEGILADECAALLCYFF

RMPRQVFNAQKKAQSSTD*SGGSSGGSSGSETPGTSESATPESSGGSSGGS*KRNYILGLAIGI

TSVGYGIIDYETRDVIDAGVRLFKEANVENNEGRRSKRGARRLKRRRHRIQRVKKLLF

DYNLLTDHSELSGINPYEARVKGLSQKLSEEEFSAALLHLAKRRGVHNVNEVEEDTGNE

LSTKEQISRNSKALEEKYVAELQLERLKKDGEVRGSINRFKTSDYVKEAKQLLKVQKA

YHQLDQSFIDTYIDLLETRRTYYEGPGEGSPFGWKDIKEWYEMLMGHCTYFPEELRSVK

YAYNADLYNALNDLNNLVITRDENEKLEYYEKFQIIENVFKQKKKPTLKQIAKEILVNE

EDIKGYRVTSTGKPEFTNLKVYHDIKDITARKEIIENAELLDQIAKILTIYQSSEDIQEELT

NLNSELTQEEIEQISNLKGYTGTHNLSLKAINLILDELWHTNDNQIAIFNRLKLVPKKVD

LSQQKEIPTTLVDDFILSPVVKRSFIQSIKVINAIIKKYGLPNDIIIELAREKNSKDAQKMIN

EMQKRNRQTNERIEEIIRTTGKENAKYLIEKIKLHDMQEGKCLYSLEAIPLEDLLNNPFN

YEVDHIIPRSVSFDNSFNNKVLVKQEENSKKGNRTPFQYLSSSDSKISYETFKKHILNLAK

GKGRISKTKKEYLLEERDINRFSVQKDFINRNLVDTRYATRGLMNLLRSYFRVNNLDVK

VKSINGGFTSFLRRKWKFKKERNKGYKHHAEDALIIANADFIFKEWKKLDKAKKVMEN

QMFEEKQAESMPEIETEQEYKEIFITPHQIKHIKDEKDYKYSHRVDKKPNRkLINDTLYST

RKDDKGNTLIVNNLNGLYDKDNDKLKKLINKSPEKLLMYHHDPQTYQKLKLIMEQYG

DEKNPLYKYYEETGNYLTKYSKKDNGPVIKKIKYYGNKLNAHLDITDDYPNSRNKVVK

LSLKPYREDVYLDNGVYKEVTVKNLDVIKKENYYEVNSKCYEEAKKLKKISNQAEFIAS

-continued

FY<u>k</u>NDLIKINGELYRVIGVNNDLLNRIEVNMIDITYREYLENMNDKRPP<u>h</u>IIKTIASKTQSI

KKYSTDILGNLYEVKSKKHPQIIKKG*EGADKRTADGSEFES*PKKKRKV.

Figure 7B:
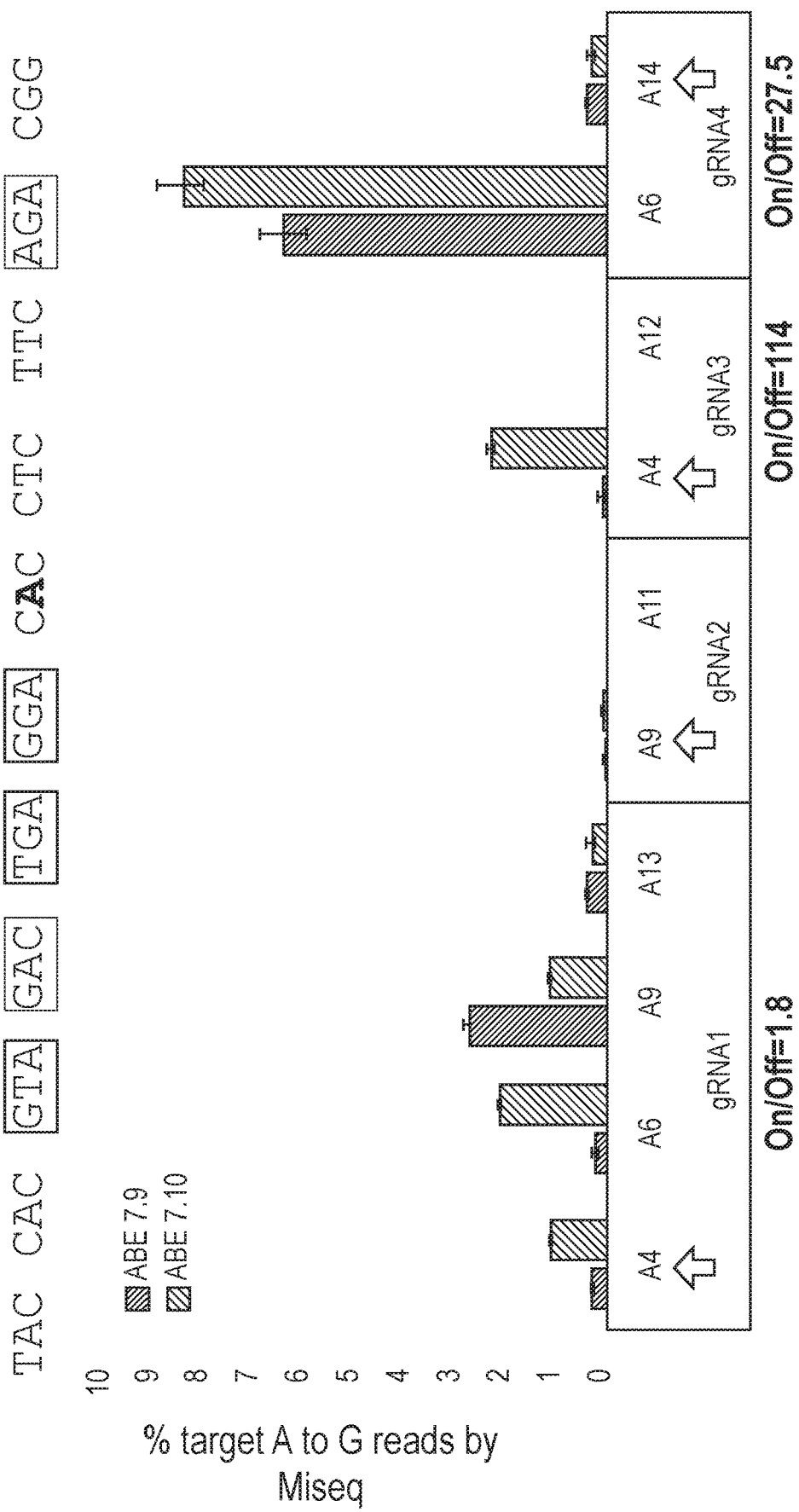

To examine base editing at the sickle cell disease site, HEK293T cells containing a lentiviral integrated copy of an HBB polynucleotide with the sickle cell disease SNP were co-transfected with a plasmid encoding ABE SaCas9 KKH, ABE SpCas9 MQKSER, or ABE SpCas9 VRQR, and corresponding guide RNAs comprising a spacer targeting the sickle cell site adjacent to the respective PAMs. In particular, ABE7.10 SaCas9 KKH showed activity at the sickle cell disease SNP (A4) in combination with a guide RNA comprising a spacer targeting the sickle cell site adjacent an NNNRRT PAM (CATGGT, FIG. 7A): UCCACAGGAGU-CAGAUGCAC (SEQ ID NO: 8) (20-nt). The base editor ABE SaCas9 KKH converted A•T to G•C at the sickle cell disease target site SNP, as determined by high throughput sequencing (HTS). Percent editing was measured by A•T to G•C base editing in nucleotide positions A4, A6, A9, and A13.

Figures 8A, 8B:
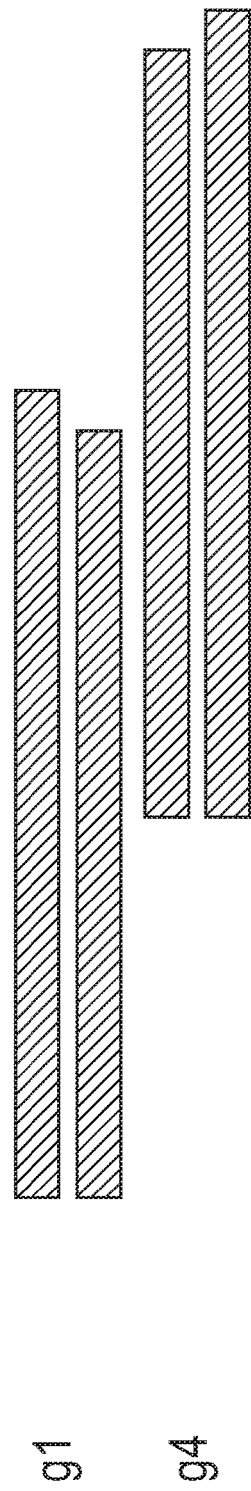
FIGS. 8A-8G depict the results of experiments to edit the adenosine (A) to a guanosine (G) in the codon encoding valine at amino acid position 6 of HbS (CAC) using a Staphylococcus aureus Cas9 variant having tolerance for NNNRRT (saKKH), either alone or fused to DNA binding domains having sequence specificity at the sickle cell target site.

To further examine base editing at the sickle cell disease site, zinc finger protein fusions were fused to ABE SaCas9 KKH (saKKH ABE7.10) (FIG. 8A). It was hypothesized that adding zinc fingers to ABE SaCas9 KKH/saKKH ABE7.10 had the potential to enhance base editing. Zinc finger nucleases that bind at the HBB locus have been generated and used as part of a nuclease-based genetic correction strategy (Sebastiano et al. Stem Cells. 2011; 29(11): 1717-1726). Two constructs were made and were termed saKKH ABE7.10 zf1ra (recognition helix sequences RNEHLEV (SEQ ID NO: 14), QSTTLKR (SEQ ID NO: 15), and RTEHLAR (SEQ ID NO: 16)) and saKKH ABE7.10 zf1rb (recognition helix sequences RGEHLRQ (SEQ ID NO: 17), QSGTL (SEQ ID NO: 234), RNDKLVP (SEQ ID NO: 19)) (FIG. 8A).

Figure 8C:
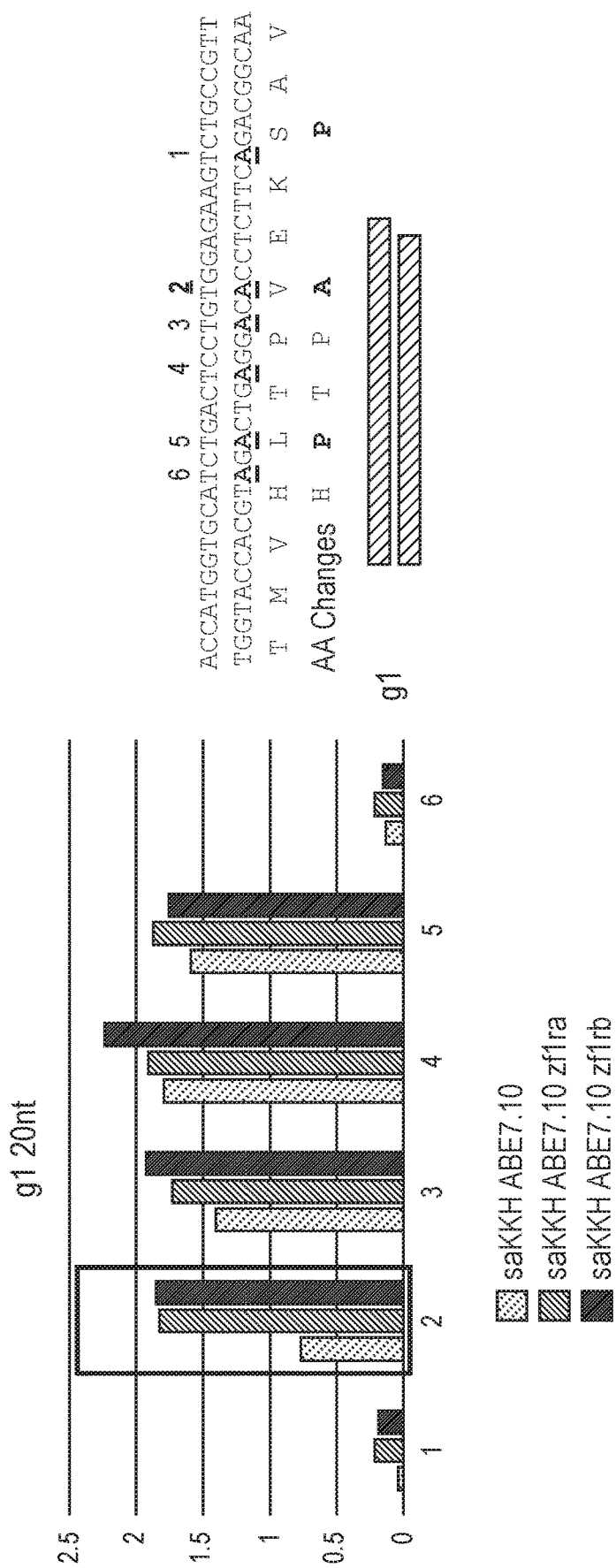
Figure 8D:
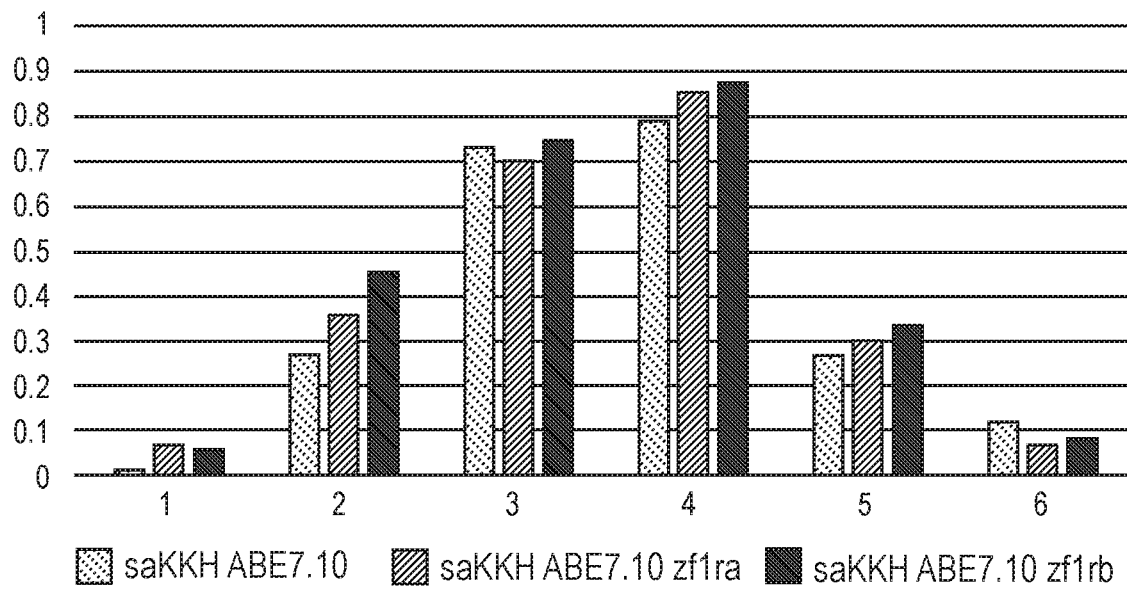
Figure 8E:
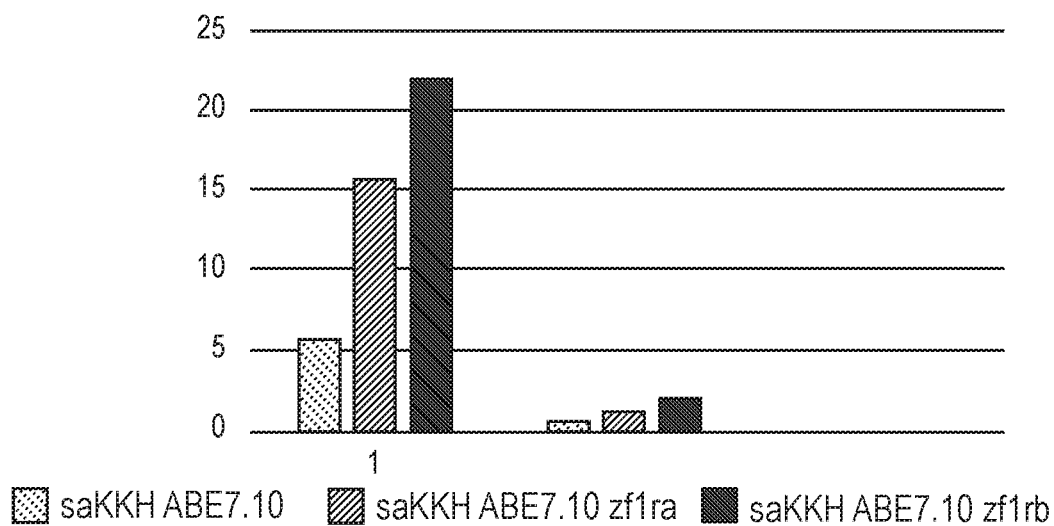
Figures 8F, 8G:
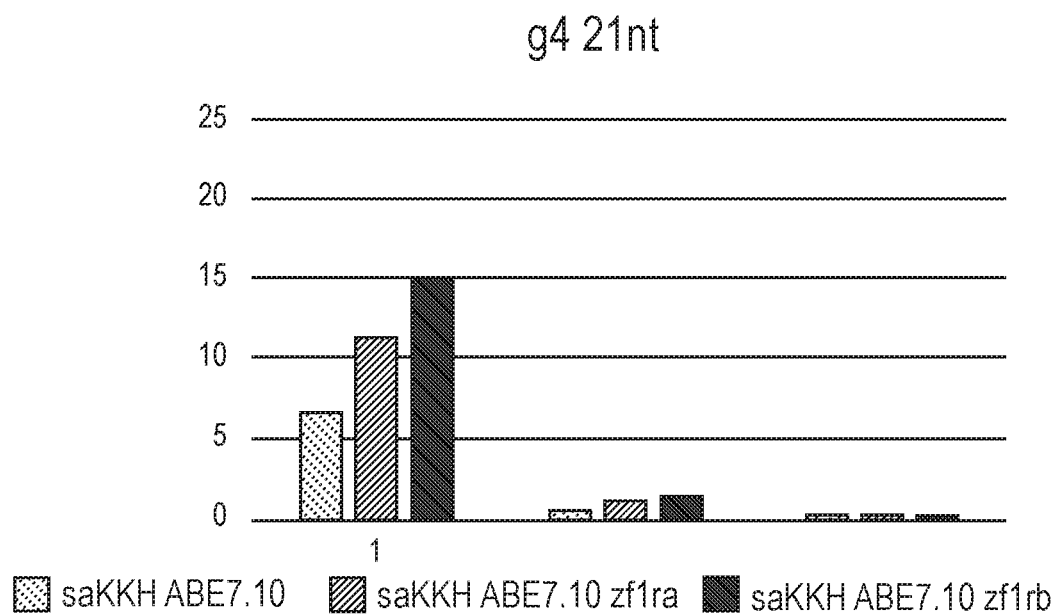

HEK293T cells containing a lentiviral integrated copy of an HBB polynucleotide with the sickle cell disease SNP were co-transfected with a plasmid encoding saKKH ABE7.10, saKKH ABE7.10 zf1ra, or saKKH ABE7.10 zf1rb, and guide RNA comprising a spacer targeting the sickle cell site adjacent the CATGGT PAM (FIG. 8B). All base editors showed activity at the sickle cell disease SNP (corresponding to position 2, FIG. 8B), as determined by high throughput sequencing (HTS) (FIGS. 8C, 8D, 8E, and 8F). In particular, the ABE7.10 zf1ra and saKKH ABE7.10 zf1rb base editors showed increased activity at the sickle cell disease SNP compared to saKKH ABE7.10 when used in combination with a 20-nt guide (FIG. 8C). Accordingly, base editing of the sickle cell disease SNP is useful in compositions and methods for treating sickle cell disease.

Example 4. An A-to-G Base Editor with a *Streptococcus thermophilus* 1 Cas9 Polynucleotide Programmable DNA Binding Domain (ABE St1Cas9) Editor has Base Editing Activity on the SNP Associated with Sickle Cell Disease An A-to-G nucleobase editor was constructed comprising a *Streptococcus thermophilus* 1 Cas9 nucleic acid programmable DNA binding domain and heterodimer of wild-type TadA and TadA7.10 (ABE St1Cas9). The TadA7.10 domain has adenosine deaminase activity on adenine in DNA, and the *S. thermophilus* nCas9 (D9A) domain has nickase activity. For use in eukaryotic genome editing, the ABE St1Cas9 includes nuclear localization signals at its N- and C-termini. The amino acid sequence of ABE St1Cas9 is provided below. (NLS in bold-wtTadA underlined-a.a. linker italics-TadA*7.10 underlined-a.a. linker italics-nSt1Cas9-NLS-BP-NLS bold italics):

(SEQ ID NO: 22)
MPKKKRKVSEVEFSHEYWMRHALTLAKRAWDEREVPVGAVLVHNNRVIGEGWNRPI

GRHDPTAHAEIMALRQGGLVMQNYRLIDATLYVTLEPCVMCAGAMIHSRIGRVVFGAR

DAKTGAAGSLMDVLHHPGMNHRVEITEGILADECAALLSDFFRMRRQEIKAQKKAQSS

TD*SGGSSGGSSGSETPGTSESATPESSGGSSGGS*SEVEFSHEYWMRHALTLAKRARDEREV

PVGAVLVLNNRVIGEGWNRAIGLHDPTAHAEIMALRQGGLVMQNYRLIDATLYVTEEP

CVMCAGAMIHSRIGRVVFGVRNAKTGAAGSLMDVLHYPGMNHRVEITEGILADECAA

LLCYFFRMPRQVFNAQKKAQSSTD*SGGSSGGSSGSETPGTSESATPES*DLVLGL<u>A</u>IGIGSV

GVGILNKVTGEIIHKNSRIFPAAQAENNLVRRTNRQGRRLARRKKHRRVRLNRLFEESG

LITDFTKISINLNPYQLRVKGLTDELSNEELFIALKNMVKHRGISYLDDASDDGNSSVGD

YAQIVKENSKQLETKTPGQIQLERYQTYGQLRGDFTVEKDGKKHRLINVFPTSAYRSEA

LRILQTQQEFNPQITDEFINRYLEILTGKRKYYHGPGNEKSRTDYGRYRTSGETLDNIFGI

LIGKCTEYPDEFRAAKASYTAQEFNLLNDLNNLTVPTETKKLSKEQKNQIINYVKNEKA

MGPAKLFKYIAKLLSCDVADIKGYRIDKSGKAEIHTFEAYRKMKTLETLDIEQMDRETL

DKLAYVLTLNTEREGIQEALEHEFADGSFSQKQVDELVQFRKANSSIPGKGWHNFSVKL

MMELIPELYETSEEQMTILTRLGKQKTTSSSNKTKYIDEKLLTEEIYNPVVAKSVRQAIKI

VNAAIKEYGDEDNIVIEMARETNEDDEKKAIQKIQKANKDEKDAAMLKAANQYNGKA

-continued
ELPHSVFHGHKQLATKIRLWHQQGERCLYTGKTISIHDLINNSNQFEVDHILPLSITFDDS

LANKVLVYATANQEKGQRTPYQALDSMDDAWSFRELKAFVRESKTLSNKKKEYLLTE

EDISKEDVRKKFIERNLVDTLYASRVVLNALQEHFRAHKIDTKVSVVRGQFTSQLRRHW

GIEKTRDTYHHHAVDALIIAASSQLNLWKKQKNTLVSYSEDQLLDIETGELISDDEYKES

VFKAPYQHFVDTLKSKEFEDSILESYQVDSKFNRKISDATIYATRQAKVGKDKADETYV

LGKIKDIYTQDGYDAFMKIYKKDKSKFLMYRHDPQTFEKVIEPILENYPNKQINDKGKE

VPCNPFLKYKEEHGYIRKYSKKGNGPEIKSLKYYDSKLGNHIDITPKDSNNKVVLQSVSP

WRADVYFNKTTGKYEILGLKYADLQFDKGTGTYKISQEKYNDIKKKEGVDSDSEEKFT

LYKNDLLLVKDTETKEQQLERELSRTMPKQKHYVELKPYDKQKFEGGEALIKVLGNVA

NSGQCKKGLGKSNISIYKVRTDVLGNQHIIKNEGDKPKLDF*PKKKRKVEGADKRTADGS*

*EFESPKKKRKV*

Base editing activity of ABE St1Cas9 was tested in HEK293T cells at sites adjacent the PAM sequences: 5'-NNAGAA-3' and 5'-NNACCA-3'. These PAMs represent putative PAMs for the ABE St1Cas9, identified as alternate PAMs for St1Cas9 nuclease based on site-depletion assays (Kleinstiver et. al. Nature (2015) 523: 481-485). To confirm that ABE St1Cas9 accepted these PAMs, HEK293T cells were co-transfected with a plasmid encoding ABE St1Cas9 and an appropriate sgRNA, that targeted 20-nucleotide sequences 5' of NNAGAA or NNACCA PAM sequences. After allowing five days for nucleobase editing to occur, genomic DNA was extracted from the cells, and the loci were analyzed by high throughput sequencing (HTS).

ABE St1Cas9 converted A to G at the target sites adjacent NNAGAA PAM sequences (FIGS. 9A and 9B, top). This is also shown, for example, by conversion of T to C on the strand opposite the PAM (see FIG. 9A: TTCTAG, the reverse complement of CTAGAA, is shown). Untreated cells maintained under similar conditions, but in the absence of a base editor, displayed no such modifications (FIGS. 9A and 9B, bottom). Base editing by St1Cas9 displayed low levels of indel formation, e.g., compared to St1Cas9 nuclease targeting the same sequences. (FIGS. 9A and 9B, tabular inset).

ABE St1Cas9 converted A to G at the target sites adjacent NNACCA PAM sequences (FIGS. 9C and 9D, top). This was shown by conversion of T to C on the strand opposite the PAM (TGGTNN, the reverse complement of NNACCA, is shown). Untreated cells maintained under similar conditions but in the absence of a base editor displayed no such modifications (FIGS. 9C and 9D, bottom). Base editing by St1Cas9 displayed low levels of indel formation, e.g., compared to St1Cas9 nuclease targeting the same sequences. (FIGS. 9C and 9D, tabular inset).

The sickle cell site in the HBB gene has an NNACCA present that places the disease-relevant "A" (opposite the sickle cell SNP "T") at position 9 in a 21-nt protospacer of a guide RNA: ACUUCUCCACAGGAGUCAGAU (SEQ ID NO: 6). Editing the disease-relevant "A" causes a T-to-C coding mutation, thereby effecting a Val→Ala substitution in β-globin. It is noted that T-to-C coding mutations at positions 11 and 14 in the spacer region are also possible. However, these occur at wobble positions in their respective codons, and are thus silent because they result in no change of the amino acids at these positions (T4 and P5). Guide RNAs targeting the sickle cell disease SNP can also be generated with a 20-nt spacer: CUUCUCCACAGGAGU-CAGAU (SEQ ID NO: 5) or 22-nt spacer: CUUCUC-CACAGGAGUCAGAU (SEQ ID NO: 5).

To examine base editing at the sickle cell disease site, HEK293T cells containing a lentiviral integrated copy of an HBB polynucleotide with the sickle cell disease SNP were co-transfected with a plasmid encoding ABE St1Cas9 and a guide RNA comprising a spacer targeting the sickle cell site adjacent the NNACCA PAM. ABE St1Cas9 converted A•T to G•C at the sickle cell disease target site SNP (FIG. 9E, top). This was shown by conversion of T to C on the strand opposite the NNACCA PAM (TGGTGC, the reverse complement of GCACCA, is shown in FIG. 9E). Untreated cells maintained under similar conditions but in the absence of a base editor displayed no such modifications (FIG. 9E, bottom). Base editing by St1Cas9 displayed low levels of indel formation, e.g., compared to St1Cas9 nuclease targeting the same sequences. (FIG. 9E, tabular inset). Accordingly, the ability to base edit the sickle cell disease SNP is useful in compositions and methods for treating sickle cell disease.

Example 5. An A-to-G Base Editor with a Modified *Streptococcus pyogenes* Cas9 (SpCas9) Polynucleotide Programmable DNA Binding Domain (Ngc-ABE) Editor has Base Editing Activity on the SNP Associated with Sickle Cell Disease A modified *Streptococcus pyogenes* Cas9 was developed, comprising the substitution D1332A in combination with one or more of D135M, S1136Q, G12128K, E1219F, A1322R, R1335E, and T1337R, relative to the wild-type SpCas9 amino acid sequence. It was found that a modified SpCas9 having D1135M, S1136Q, G12128K, E1219F, A1322R, D1332A, R1335E, and T1337R substitutions can accept NGC PAMs. An A-to-G nucleobase editor was constructed comprising a modified *S. pyogenes* Cas9 nucleic acid programmable DNA binding domain that accepted NGC PAMs and heterodimer of wild-type TadA and TadA7.10 (ngc-Cas9). The TadA7.10 domain has adenosine deaminase activity on adenine in DNA, and the *S. pyogenes* nCas9 (D10A) domain has nickase activity. For use in eukaryotic genome editing, the ngc-ABE includes a nuclear localization signal at its C-terminus. The amino acid sequence of ngc-ABE is provided below (wtTadA underlined-a.a. linker italics-TadA*7.10 underlined-a.a. linker italics-ngc-Cas9-a.a. linker italics-NLS bold italics; a.a. substitutions in lowercase):

(SEQ ID NO: 235)
MSEVEFSHEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVEGARDAKTGA

AGSLMDVLHHPGMNHRVEITEGILADECAALLSDFFRMRRQEIKAQKKAQSSTD*SGGSS*

*GGSSGSETPGTSESATPESSGGSSGGSS*EVEFSHEYWMRHALTLAKRARDEREVPVGAVL

VLNNRVIGEGWNRAIGLHDPTAHAEIMALRQGGLVMQNYRLIDATLYVTFEPCVMCA

GAMIHSRIGRVVFGVRNAKTGAAGSLMDVLHYPGMNHRVEITEGILADECAALLCYFF

RMPRQVFNAQKKAQSSTD*SGGSSGGSSGSETPGTSESATPESSGGSSGGS*DKKYSIGLAIG

TNSVGWAVITDEYKVPSKKFKVLGNTDRHSIKKNLIGALLFDSGETAEATRLKRTARRR

YTRRKNRICYLQEIFSNEMAKVDDSFEHRLEESELVEEDKKHERHPIEGNIVDEVAYHEK

YPTIYHLRKKLVDSTDKADLRLIYLALAHMIKFRGHFLIEGDLNPDNSDVDKLFIQLVQT

YNQLFEENPINASGVDAKAILSARLSKSRRLENLIAQLPGEKKNGLFGNLIALSLGLTPNF

KSNFDLAEDAKLQLSKDTYDDDLDNLLAQIGDQYADLFLAAKNLSDAILLSDILRVNTE

ITKAPLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQEDFYP

FLKDNREKIEKILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFLSGEQKKAIV

DLLFKTNRKVTVKQLKEDYFKKIECFDSVEISGVEDRFNASLGTYHDLLKIIKDKDFLDN

EENEDILEDIVLTLTLFEDREMIEERLKTYAHLFDDKVMKQLKRRRYTGWGRLSRKLIN

GIRDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKRIE

EGIKELGSQILKEHPVENTQLQNEKLYLYYLQNGRDMYVDQELDINRLSDYDVDHIVPQ

SFLKDDSIDNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIREVKVITLKSK

LVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGR

DFATVRKVLSMPQVNIVKKTEVQTGGFSKESILPKRNSDKLIARKKDWDPKKYGGFmq

PTVAYSVLVVAKVEKGKSKKLKSVKELLGITIMERSSFEKNPIDFLEAKGYKEVKKDLII

KLPKYSLFELENGRKRMLASAkfLQKGNELALPSKYVNFLYLASHYEKLKGSPEDNEQK

QLFVEQHKHYLDEIIEQISEFSKRVILADANLDKVLSAYNKHRDKPIREQAENIIHLFTLT

NLGAPrAFKYFDTTIaRKeYrSTKEVLDATLIHQSITGLYETRIDLSQLGGD*EGADKRTAD*

*GSEFESPKKKRKV*.

Figure 10:
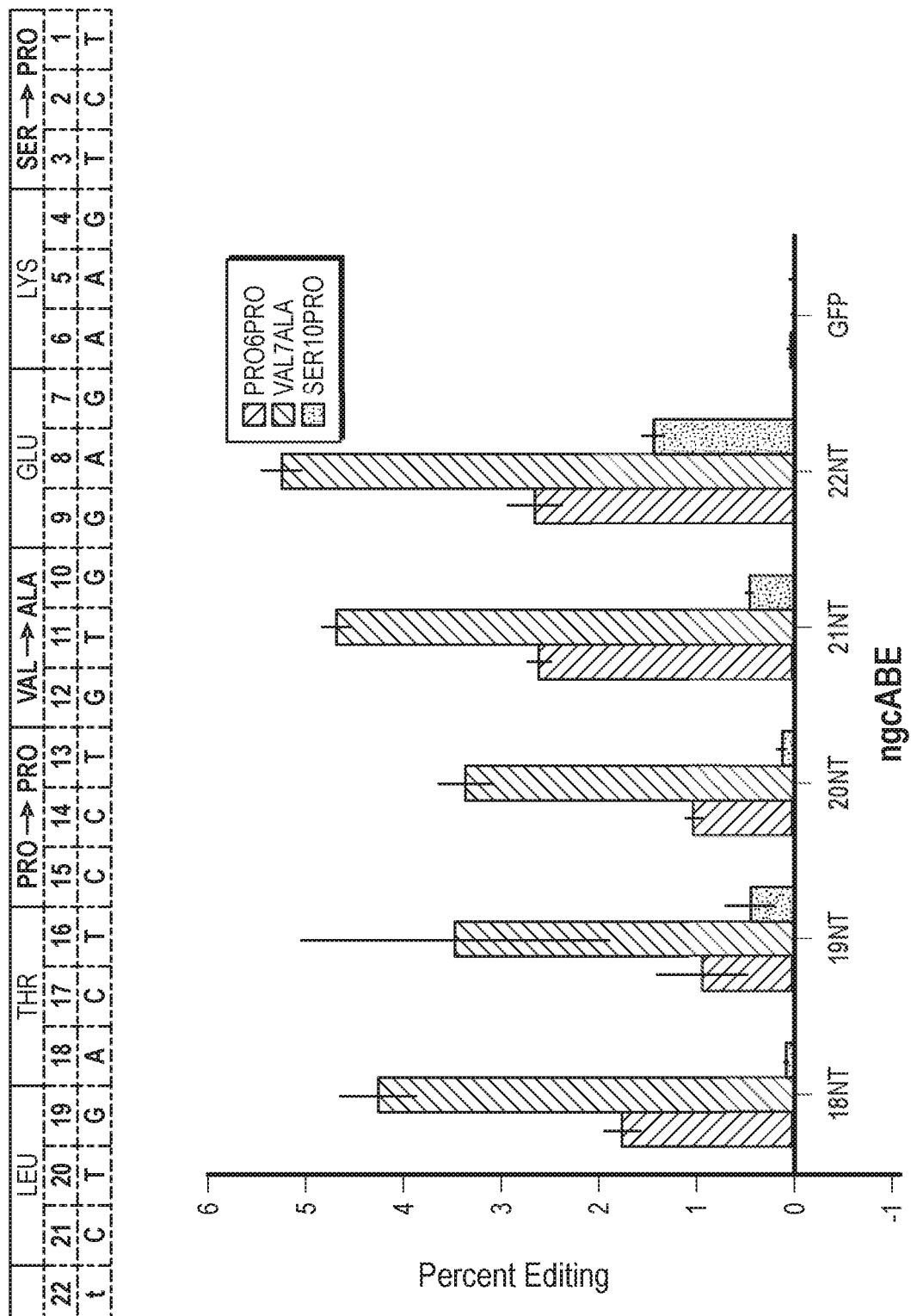
FIG. 10 depicts percent base editing at the sickle cell target site using an ABE having an SpCas9 DNA binding domain evolved and engineered to accept NGC PAMs (ngcABE). In the bar graph, the leftmost bar represents "Pro6Pro;" the middle bar represents "Val7Ala;" and the rightmost bar represents "Ser10Pro".

To examine base editing at the sickle cell disease site, HEK293T cells containing a lentiviral integrated copy of an HBB polynucleotide with the sickle cell disease SNP were co-transfected with a plasmid encoding ngc-ABE and a guide RNA comprising a spacer targeting the sickle cell site adjacent an NGC PAM (TGC, the reverse complement of GCA, is shown in FIG. 10) selected from the following: UUCUCCACAGGAGUCAGA (SEQ ID NO: 9) (18-nt); CUUCUCCACAGGAGUCAGA (SEQ ID NO: 10) (19-nt); ACUUCUCCACAGGAGUCAGA (SEQ ID NO: 11) (20-nt); GACUUCUCCACAGGAGUCAGA (SEQ ID NO: 12) (21-nt); and AGACUUCUCCACAGGAGUCAGA (SEQ ID NO: 13) (22-nt). The base editor ngc-ABE converted A•T to G•C at the sickle cell disease target site SNP, as determined by high throughput sequencing (HTS). Percent editing was measured by A•T to G•C base editing in codons corresponding to amino acid positions P6, E7, and S10, relative to the full-length 0-globin polypeptide including the methionine encoded by the start codon. Base editing at these positions resulted in P6P (silent), E7A, and S10P substitutions. Cells transfected with GFP and no base editor displayed no base editing. Accordingly, the ability to base edit the sickle cell disease SNP is useful in compositions and methods for treating sickle cell disease. Shown in FIG. 10 is the percent base editing at the sickle cell target site using the ABE having an SpCas9 DNA binding domain which accepts NGC PAMs (ngcABE).

The gRNA comprised the nucleic acid sequence: 5'-GAC-UUCUCCACAGGAGUCAGA GUUUUAGAGC UAGAAAUAGC AAGUUAAAAU AAGGCUAGUC CGUUAUCAAC UUGAAAAAGU GGCACCGAGU CGGUGCUUUU-3' (SEQ ID NO: 236), in which the first and the last three bases were phosphorothioate and 20-ME modified. The sequence of the ngcABE base editor used is as follows:

(SEQ ID NO: 237)

ATGAGCGAGGTGGAATTCAGCCACGAGTACTGGATGCGGCACGCCCTGACACTGGC

CAAAAGAGCTTGGGACGAGAGGGAAGTGCCTGTGGGAGCTGTGCTGGTGCACAAC

AACAGAGTGATCGGCGAAGGCTGGAACAGACCCATCGGCAGACACGATCCTACAG

CTCACGCCGAGATCATGGCCCTGAGACAAGGCGGACTGGTCATGCAGAACTACCGG

CTGATCGACGCCACACTGTACGTGACCCTGGAACCTTGCGTGATGTGTGCCGGCGCT

ATGATCCACAGCAGAATCGGCAGAGTGGTGTTCGGCGCCAGAGATGCCAAAACAG

GCGCTGCCGGAAGCCTGATGGATGTGCTGCATCACCCCGGCATGAACCACAGAGTG

GAAATCACCGAGGGCATCCTGGCCGATGAATGTGCCGCTCTGCTGAGCGACTTCTTC

CGGATGCGGCGGCAAGAGATCAAGGCCCAGAAGAAGGCCCAGTCCAGCACAGATA

GCGGCGGATCTAGCGGAGGCAGCTCTGGATCTGAGACACCTGGCACAAGCGAGAG

CGCCACACCTGAAAGTTCTGGCGGTTCTTCTGGCGGCAGCAGCGAGGTCGAGTTCTC

TCACGAATATTGGATGAGACACGCTCTCACCCTGGCTAAGAGAGCCAGGGACGAAA

GAGAGGTGCCAGTTGGCGCTGTCCTGGTGTTGAACAATCGCGTCATCGGAGAAGGA

TGGAATCGCGCCATTGGCCTGCACGATCCAACCGCACATGCCGAAATTATGGCTCT

GCGGCAAGGCGGCCTCGTGATGCAAAATTACAGACTGATCGATGCTACCCTCTACG

TCACCTTCGAGCCCTGTGTCATGTGTGCTGGGGCAATGATTCACTCCCGGATTGGCC

GCGTGGTGTTTGGAGTGCGGAATGCCAAGACTGGCGCCGCTGGATCTCTGATGGAC

GTCCTGCACTATCCTGGGATGAACCACCGGGTCGAGATCACAGAGGGAATTCTGGC

TGACGAGTGCGCTGCCCTGCTGTGCTACTTCTTTAGAATGCCCAGACAGGTGTTCAA

CGCCCAGAAAAAGCTCAGAGCAGCACCGATTCCGGCGGAAGCAGCGGAGGATCT

TCTGGAAGCGAAACCCCAGGCACCAGCGAGTCTGCCACACCAGAATCATCTGGCGG

TAGCTCCGGCGGCAGCGACAAGAAGTATTCTATCGGACTGGCCATCGGCACCAACT

CTGTTGGATGGGCCGTGATCACCGACGAGTACAAGGTGCCCAGCAAGAAATTCAAG

GTGCTGGGCAACACCGACAGGCACAGCATCAAGAAGAACCTGATCGGCGCACTGCT

GTTCGACTCTGGCGAAACAGCCGAGGCCACCAGACTGAAGAGAACAGCCCGCAGA

CGGTACACCAGAAGAAAGAACCGGATCTGCTACCTCCAAGAGATCTTCAGCAACGA

GATGGCCAAGGTGGACGACAGCTTCTTCCACAGACTGGAAGAGTCCTTCCTGGTGG

AAGAGGACAAGAAGCACGAGAGACACCCCATCTTCGGCAACATCGTGGACGAGGT

GGCCTACCACGAGAAGTACCCCACCATCTACCACCTGAGAAAGAAACTGGTGGACA

GCACCGACAAGGCCGACCTGAGACTGATCTATCTGGCCCTGGCTCACATGATCAAG

TTCCGGGGCCACTTCCTGATCGAGGGCGACCTGAATCCTGACAACAGCGACGTGGA

CAAGCTGTTCATCCAGCTGGTGCAGACCTACAACCAGCTGTTCGAGGAAAACCCCA

TCAACGCCAGCGGAGTGGATGCCAAGGCCATCCTGTCTGCCAGACTGAGCAAGAGC

AGACGGCTGGAAAATCTGATCGCCCAGCTGCCTGGCGAGAAGAAGAATGGCCTGTT

CGGCAACCTGATTGCCCTGAGCCTGGGCCTGACACCTAACTTCAAGAGCAACTTCG

ACCTGGCCGAGGACGCCAAACTGCAGCTGAGCAAGGACACCTACGACGACGACCT

GGACAATCTGCTGGCCCAGATCGGCGATCAGTACGCCGACTTGTTTCTGGCCGCCA

AGAATCTGAGCGACGCCATCCTGCTGTCCGACATCCTGAGAGTGAACACCGAGATC

-continued

```
ACCAAGGCACCTCTGAGCGCCTCTATGATCAAGAGATACGACGAGCACCACCAGGA
TCTGACCCTGCTGAAGGCCCTCGTTAGACAGCAGCTGCCAGAGAAGTACAAAGAGA
TTTTCTTCGACCAGAGCAAGAACGGCTACGCCGGCTACATTGATGGCGGAGCCAGC
CAAGAGGAATTCTACAAGTTCATCAAGCCCATCCTCGAGAAGATGGACGGCACCGA
GGAACTGCTGGTCAAGCTGAACAGAGAGGACCTGCTGAGAAAGCAGAGAACCTTC
GACAACGGCAGCATCCCTCACCAGATCCACCTGGGAGAACTGCACGCCATTCTGCG
GAGACAAGAGGACTTTTACCCATTCCTGAAGGACAACCGGGAAAAGATCGAGAAA
ATCCTGACCTTCAGGATCCCCTACTACGTGGGACCACTGGCCAGAGGCAATAGCAG
ATTCGCCTGGATGACCAGAAAGAGCGAGGAAACCATCACTCCCTGGAACTTCGAGG
AAGTGGTGGACAAGGGCGCCAGCGCTCAGTCCTTCATCGAGCGGATGACCAACTTC
GATAAGAACCTGCCTAACGAGAAGGTGCTGCCCAAGCACAGCCTGCTGTACGAGTA
CTTCACCGTGTACAACGAGCTGACCAAAGTGAAATACGTGACCGAGGGAATGAGAA
AGCCCGCCTTTCTGAGCGGCGAGCAGAAAAAGGCCATCGTGGATCTGCTGTTCAAG
ACCAACCGGAAAGTGACCGTGAAGCAGCTGAAAGAGGACTACTTCAAGAAAATCG
AGTGCTTCGACAGCGTCGAGATCTCCGGCGTGGAAGATCGGTTCAATGCCAGCCTG
GGCACATACCACGATCTGCTGAAAATTATCAAGGACAAGGACTTCCTGGACAACGA
AGAGAACGAGGACATCCTTGAGGACATCGTGCTGACACTGACCCTGTTTGAGGACA
GAGAGATGATCGAGGAACGGCTGAAAACATACGCCCACCTGTTCGACGACAAAGT
GATGAAGCAACTGAAGCGGCGGAGATACACCGGCTGGGGCAGACTGTCTCGGAAG
CTGATCAACGGCATCCGGGATAAGCAGTCCGGCAAGACCATCCTGGACTTTCTGAA
GTCCGACGGCTTCGCCAACAGAAACTTCATGCAGCTGATTCACGACGACAGCCTCA
CCTTCAAAGAGGATATCCAGAAAGCCCAGGTGTCCGGCCAGGGCGATTCTCTGCAT
GAGCACATTGCCAACCTGGCCGGCTCTCCCGCCATTAAGAAAGGCATCCTGCAGAC
AGTGAAGGTGGTGGACGAGCTTGTGAAAGTGATGGGCAGACACAAGCCCGAGAAC
ATCGTGATCGAAATGGCCAGAGAGAACCAGACCACACAGAAGGGACAGAAGAACA
GCCGCGAGAGAATGAAGCGGATCGAAGAGGGCATCAAAGAGCTGGGCAGCCAGAT
CCTGAAAGAACACCCCGTGGAAAACACCCAGCTGCAGAACGAGAAGCTGTACCTGT
ACTACCTGCAGAATGGACGGGATATGTACGTGGACCAAGAGCTGGACATCAACAGA
CTGTCCGACTACGATGTGGACCATATCGTGCCCCAGTCTTTTCTGAAGGACGACTCC
ATCGACAACAAGGTCCTGACCAGATCCGACAAGAATCGGGGCAAGAGCGACAACG
TGCCCTCCGAAGAGGTGGTCAAGAAGATGAAGAACTACTGGCGACAGCTGCTGAAC
GCCAAGCTGATTACCCAGCGGAAGTTCGACAATCTGACCAAGGCCGAAAGAGGCG
GCCTGAGCGAACTGGATAAGGCCGGCTTCATCAAGAGACAGCTGGTGGAAACCCGG
CAGATCACAAAGCACGTGGCACAGATTCTGGACTCTCGGATGAACACTAAGTACGA
CGAGAACGACAAACTGATCCGCGAAGTGAAAGTCATCACCCTGAAGTCCAAGCTGG
TGTCCGATTTCCGGAAGGATTTCCAGTTCTACAAAGTGCGCGAGATCAACAACTACC
ATCACGCCCACGACGCCTACCTGAATGCCGTTGTTGGAACAGCCCTGATCAAAAAG
TACCCTAAGCTGGAAAGCGAGTTCGTGTACGGCGACTACAAGGTGTACGACGTGCG
GAAGATGATCGCCAAGAGCGAGCAAGAGATTGGCAAGGCAACCGCCAAGTACTTC
TTCTACAGCAACATCATGAACTTTTTCAAGACAGAGATCACCCTCGCCAACGGCGA
```

-continued
```
GATCAGAAAGCGGCCTCTGATCGAGACAAACGGCGAAACCGGCGAGATTGTGTGG

GATAAGGGCAGAGACTTTGCCACAGTGCGGAAAGTGCTGAGCATGCCCCAAGTGAA

TATCGTGAAGAAAACCGAGGTGCAGACAGGCGGCTTCAGCAAAGAGTCTATCCTGC

CTAAGCGGAACTCCGACAAGCTGATCGCCAGAAAGAAGGACTGGGACCCCAAGAAa

TACGGCGGCTTTATGCAGCCCACCGTGGCCTATtctGTtCTGGTGGTGGCCAAAGTGGA

AAAGGGCAAGTCCAAGAAACTCAAGAGCGTGAAAGAGCTGCTGGGGATCACCATC

ATGGAAAGAAGCAGCTTCGAGAAGAATCCGATCGATTTCCTCGAGGCCAAGGGTTA

CAAAGAAGTGAAAAAGGACCTGATCATCAAGCTCCCCAAGTACTCCCTGTTCGAGC

TGGAAAACGGCCGGAAGAGAATGCTGGCCTCTGCcAAGtteCTGCAGAAGGGAAACG

AACTGGCCCTGCCTAGCAAATATGTGAACTTCCTGTACCTGGCCAGCCACTATGAGA

AGCTGAAGGGCAGCCCCGAGGACAATGAGCAAAAGCAGCTGTTTGTGGAACAGCA

CAAGCACTACCTGGACGAGATCATCGAGCAGATCAGCGAGTTTAGCAAGAGAGTGA

TTCTGGCCGACGCCAATCTGGACAAAGTGCTGTCCGCCTACAACAAGCACCGGGAC

AAGCCTATCAGAGAGCAGGCCGAGAATATCATCCACCTGTTTACCCTGACCAACCT

GGGAGCCCCTagaGCCTTCAAGTACTTTGACACCACCATCgccCGGAAGGAGTACcggT

CCACCAAAGAGGTGCTGGACGCCACTCTGATCCACCAGTCTATCACCGGCCTGTAC

GAGACACGGATCGACCTGTCTCAACTCGGAGGCGACGAAGGCGCCGATAAGAGAA

CCGCCGATGGCTCTGAGTTCGAGAGCCCtAAGAAAAAGCGCAAAGTGTag
```

Example 6. Editing of a Regulatory Region of the HBG1/2 Genes Associated with Sickle Cell Disease (SCD)/Hereditary Persistence of Fetal Hemoglobin (HPFH)

HPFH is a benign genetic condition with heterozygous deletions or nucleotide substitutions causing high-level HbF expression throughout life. Increased levels of fetal hemoglobin (HbF) can ameliorate the clinical course of inherited disorders of beta-globin gene expression, such as beta thalassemia and sickle cell anemia. In a group of disorders called hereditary persistence of fetal hemoglobin (HPFH), the expression of one or both of the gamma-globin genes (HBG1/2) of HbF persists at high levels in adult erythroid cells.

Several regulatory elements for the normal pattern of gamma-globin gene expression and deletion as well as nondeletion types of HPFH are described in Forget B. G. "Molecular basis of hereditary persistence of fetal hemoglobin." Ann NY Acad Sci. 1998 Jun. 30; 850:38-44, the entire contents of which is hereby incorporated by reference.

The non-deletion types of HPFH are characterized by the presence of point mutations in the promoter region of either the HBG1 or the HBG2 gamma-globin gene. Such point mutations are believed to alter interactions between various transcription factors and the promoter of the genes. The deletion types of HPFH can deregulate the normal developmental pattern of gamma-globin gene expression due to the juxtaposition of normally distant cis-acting factors into the vicinity of the gamma-globin genes. Table 4 supra presents nucleotide changes and associated genes, e.g., the HBG1/2 genes, that may be effected in the regulatory region of such gene(s) by the base editors and methods described herein. The genes related to HBG are targeted for the genetic regions shown in Table 4 in order to induce persistence fetal hemoglobin. The genetic target sites are useful for recapitulating naturally occurring mutations/SNPs found in patients with hereditary persistence fetal hemoglobin (HPFH).

Figure 11:
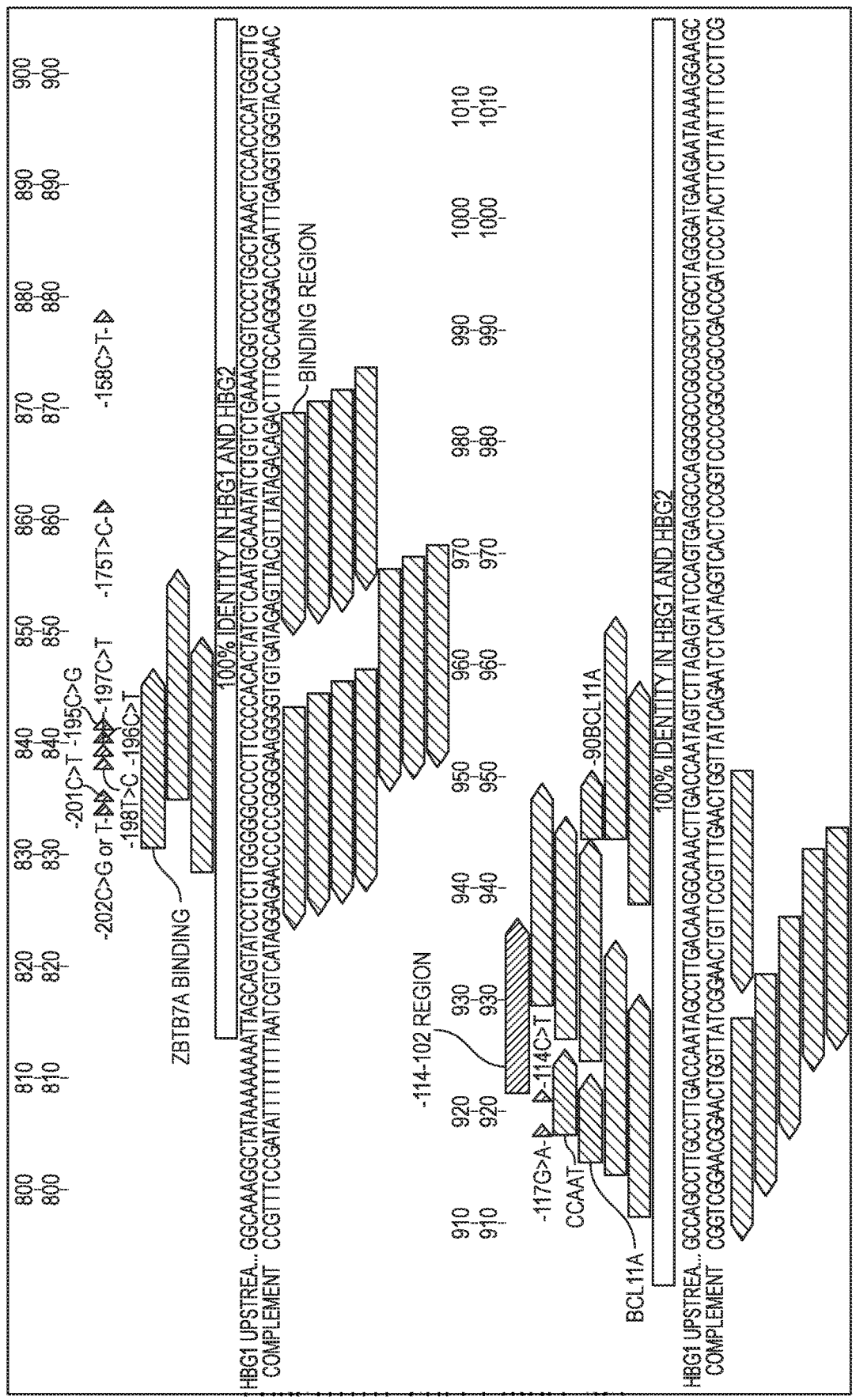
FIG. 11 is a schematic depiction representing the promoter region of the HBG1/2 gene. The individual purple triangles indicate SNPs and deletions naturally found in patients with HPFH. The green arrows, e.g., "BCL11A," "CCAAT", "90 BCL11A" and "ZBTB7A" indicate potential transcription binding sites. The thick pointed lines (pink) clustered above and below the HBG1/2 sequences indicate guide RNAs that can target these regions of interest, e.g., target sequences of the gene.
Figure 12:
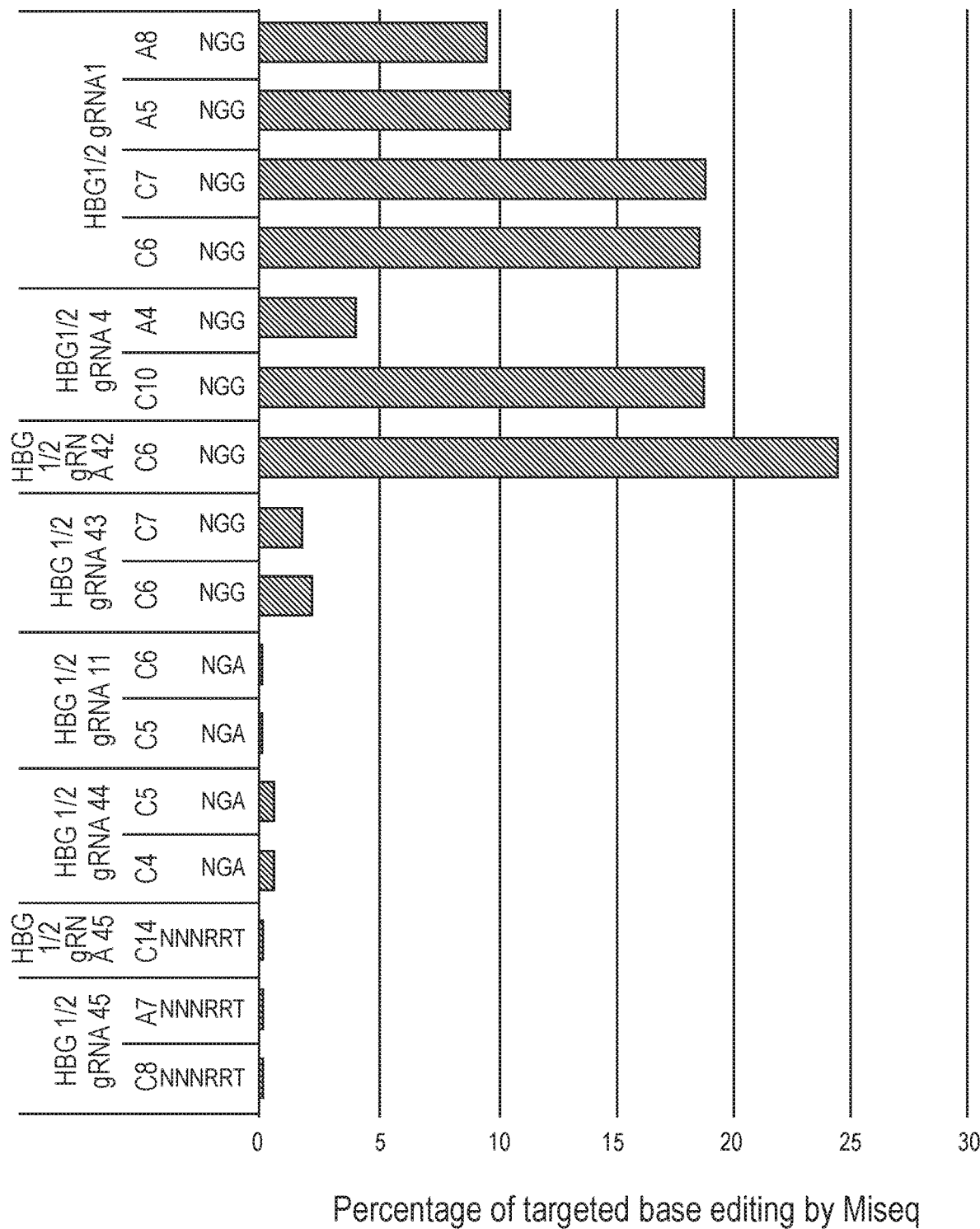
FIG. 12 shows targeted base editing rates of target sequences in the HBG1/2 gene in 293T cells transfected with indicated gRNA and Cas9 base editors. The percentage of base editing efficacy was determined by Miseq. Shown in the figure is the percentage of editing that occurred in 293T cells using each type of gRNA, for which the gene and target sequences are shown in Table 4. The "Cs" indicate the position in relation to the gRNA in which edits with the CBEs in conjunction with the gRNAs would be made. The "As" indicate the position in relation to the gRNAs in which the ABEs would edit the sequence in conjunction with the respective gRNA.
Figure 13:
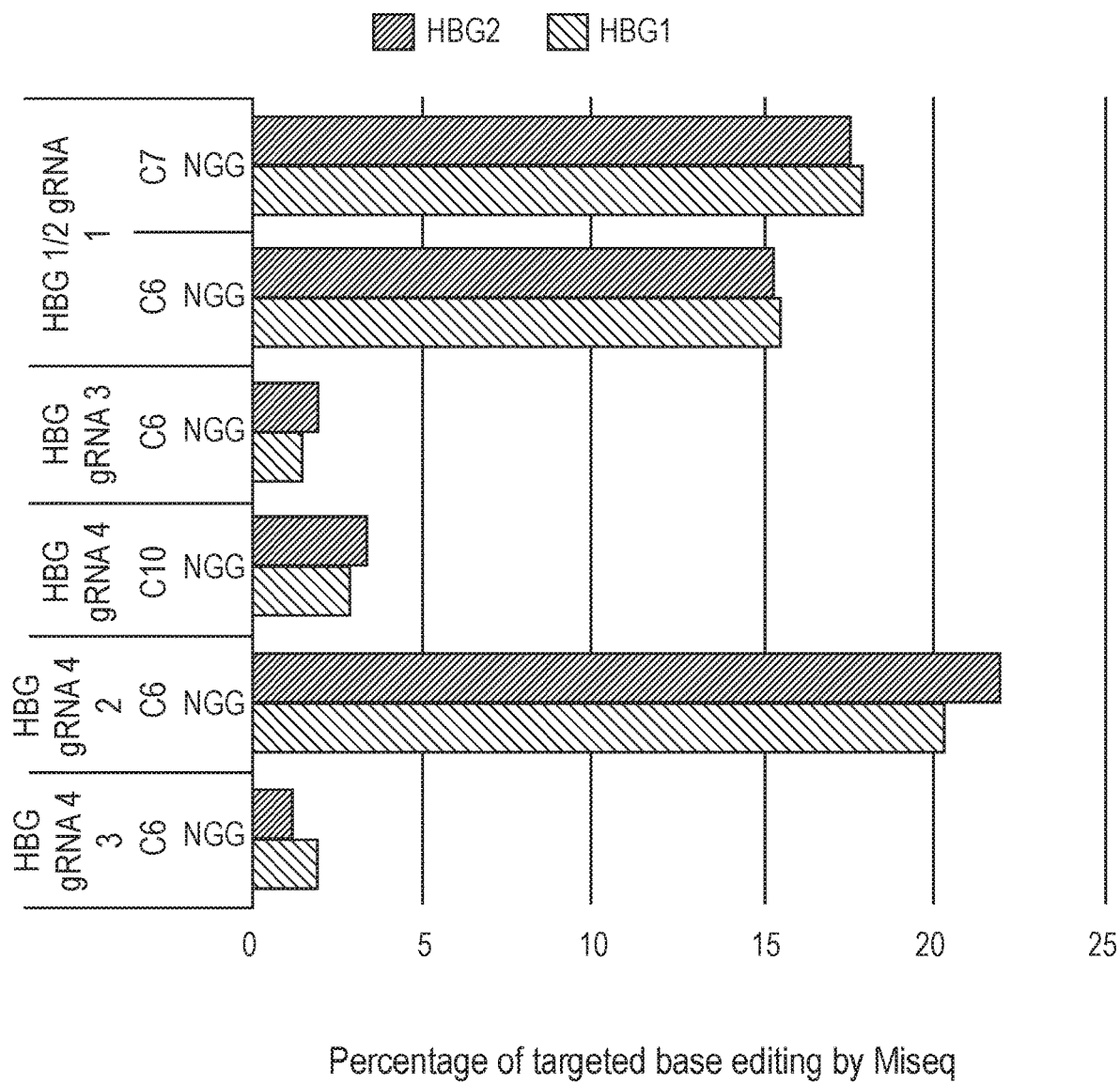
FIG. 13 indicates the percentage of editing in primary bone marrow CD34+ cells performed by each type of gRNA which in which the gene and target sequences are shown in Table 4. CD34+ cells were transfected with the indicated gRNAs and base editors. The "Cs" indicate the position in relation to the gRNA in which edits with the CBEs such as BE4, in conjunction with the gRNAs would be made. The "As" indicate the position in relation to the gRNAs in which the ABEs edit the target sequence in conjunction with the respective gRNA. Percentage of base editing at both the HBG1 and HBG2 loci were assessed by Miseq.

Guide RNAs (gRNAs) were designed to target a non-regulatory region in the regulatory region in the HBG1/2 promoter (FIG. 11). Targeted base editing rates in 293T cells transfected with indicated gRNA and Cas9 base editors are shown in FIG. 12. Percentage of base editing efficacy was determined by Miseq. The HEK293T were transfected with plasmid DNA containing either C base editor or the A base editor with the corresponding gRNA using commercially available transfection reagent (Mirus). In FIGS. 12 and 13, the target sequences of the gRNAs are as follows:

```
gRNA1:
                            (SEQ ID NO: 238)
CTTGACCAATAGCCTTGACAAGG;

gRNA3:
                            (SEQ ID NO: 239)
CAAGGCTATTGGTCAAGGCA;

gRNA4:
                            (SEQ ID NO: 240)
GCTATTGGTCAAGGCAAGGC;

gRNA11:
                            (SEQ ID NO: 241)
CTTGCCTTGACCAATAGCCTTGA;

gRNA42:
                            (SEQ ID NO: 242)
TCAGACAGATATTTGCATTGAGA;

gRNA43:
                            (SEQ ID NO: 243)
TTTCAGACAGATATTTGCATTGA;

gRNA44:
                            (SEQ ID NO: 244)
TAGCCTTGACAAGGCAAACTTGA;
```

-continued gRNA45:
(SEQ ID NO: 245)
AAGTTTGCCTTGTCAAGGCTATTGGT.

gRNA1, gRNA4 and gRNA45, as above and as noted in FIGS. 12 and 13, were used in conjunction with "A" base editors (ABEs) and "C" base editors (CBEs); the remaining gRNAs were used in conjunction with "C" base editors (CBEs). In an embodiment, the gRNA scaffold sequence is as follows: GUUUUAGAGC UAGAAAUAGC AAGUUAAAAU AAGGCUAGUC CGUUAUCAAC UUGAAAAAGU GGCACCGAGU CGGUGCUUUU (SEQ ID NO: 246).

For RNA transfections into CD34+ cells, human bone marrow CD34+ cells were purchased from HemaCare. Chemically modified gRNA, in which the first and last three base pairs of the guideRNA nucleic acid sequence were modified with 2'OMe, was synthesized by Synthego, and base editor mRNA were transcribed by TriLink. By way of example, for mRNA editing, the mRNA may be N1MePseudoU modified mRNA. As will be appreciated by the skilled practitioner in the art, 2'-O-methylation is a common nucleoside modification of RNA, where a methyl group is added to the 2' hydroxyl of the ribose moiety of a nucleoside, producing a methoxy group. CD34+ cells were thawed and cultured for two to three days for expansion before being subjected to electroporation. 500 ng of gRNA and 2500 ng of base editor mRNA were electroporated into 200,000 CD34+ cells following manufacturer's instructions. Genomic DNA was harvested three days after RNA electroporation. Genomic DNA was extracted with QuickExtract™ DNA Extraction Solution (Epicentre) at 65° C. for half an hour, followed by a heat activation at 65° C. for 5 minutes. FIG. 13 shows targeted base editing rates in primary human bone marrow CD34+ cells transfected with indicated gRNA and base editor. Percentage of base editing at both the HBG1 and HBG2 gene loci were assessed by Miseq. Genomic sites were PCR amplified and sequenced on a MiSeq. Results were analyzed for base frequencies at each position and for percent indels employing analysis methods and procedures typically used in the art for such assessments.

Example 7. Materials and Methods

Results provided in the Examples described herein were obtained using the following materials and methods.

Cloning/Transfections. PCR was performed using VeraSeq ULtra DNA polymerase (Enzymatics), or Q5 Hot Start High-Fidelity DNA Polymerase (New England Biolabs). Base Editor (BE) plasmids were constructed using USER cloning (New England Biolabs). Deaminase genes were synthesized as gBlocks Gene Fragments (Integrated DNA Technologies). Cas9 genes used are listed below. Cas9 genes were obtained from previously reported plasmids. Deaminase and fusion genes were cloned into pCMV (mammalian codon-optimized) or pET28b (E. coli codon-optimized) backbones. sgRNA expression plasmids were constructed using site-directed mutagenesis. By way of example, the gRNA plasmid comprised an art-recognized U6 promoter driving the expression of the gRNA. For BE plasmids, e.g., an ABE plasmid, a CMV promoter was used to drive the expression of the base editor open reading frame.

Briefly, the primers were 5' phosphorylated using T4 Polynucleotide Kinase (New England Biolabs) according to the manufacturer's instructions. Next, PCR was performed using Q5 Hot Start High-Fidelity Polymerase (New England Biolabs) with the phosphorylated primers and the expression plasmid encoding the gene of interest, as a template according to the manufacturer's instructions. PCR products were incubated with DpnI (20 U, New England Biolabs) at 37° C. for 1 hour, purified on a QIAprep spin column (Qiagen), and ligated using QuickLigase (New England Biolabs) according to the manufacturer's instructions. DNA vector amplification was carried out using MachI competent cells (ThermoFisher Scientific). For gRNAs, the following scaffold sequence is presented: GUUUUAGAGC UAGAAAUAGC AAGUUAAAAU AAGGCUAGUC CGUUAUCAAC UUGAAAAAGU GGCACCGAGU CGGUGCUUUU (SEQ ID NO: 246). Ibis scaffold was used for the PAMs shown in the tables herein, e.g., NGG, NGA, NGC, NGT PAMs; the gRNA encompasses the scaffold sequence and the spacer sequence (target sequence) for disease-associated genes (e.g., Tables 3A, 3B and 4) as provided herein or as determined based on the knowledge of the skilled practitioner and as would be understood to the skilled practitioner in the art. (See, e.g., Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017), and Rees, H. A., et al., "Base editing: precision chemistry on the genome and transcriptome of living cells." Nat Rev Genet. 2018 December; 19(12):770-788. doi: 10.1038/s41576-018-0059-1).

In Vitro Deaminase Assay on ssDNA.

Sequences of all ssDNA substrates are provided below. All Cy3-labelled substrates were obtained from Integrated DNA Technologies (IDT). Deaminases were expressed in vitro using the TNT T7 Quick Coupled Transcription/Translation Kit (Promega) according to the manufacturer's instructions using 1 µg of plasmid. Following protein expression, 5 µl of lysate was combined with 35 µl of ssDNA (1.8 µM) and USER enzyme (1 unit) in CutSmart buffer (New England Biolabs) (50 mM potassium acetate, 29 mM Tris-acetate, 10 mM magnesium acetate, 100 µg ml−1 BSA, pH 7.9) and incubated at 37° C. for 2 h. Cleaved U-containing substrates were resolved from full-length unmodified substrates on a 10% TBE-urea gel (Bio-Rad).

Expression and Purification of BE-Linker-Binding Protein Fusions.

Competent cells, such as E. coli BL21 STAR (DE3)-competent cells (ThermoFisher Scientific), were transformed with plasmids encoding the base editor (BE) fused to the nucleic acid binding protein via a linker, e.g., BE-linker-dCas9. The resulting expression strains were grown overnight in Luria-Bertani (LB) broth containing 100 µg ml−1 of kanamycin at 37° C. The cells were diluted 1:100 into the same growth medium and grown at 37° C. to OD600=~0.6. The culture was cooled to 4° C. over a period of 2 h, and isopropyl-β-d-1-thiogalactopyranoside (IPTG) was added at 0.5 mM to induce protein expression. After ~16 h, the cells were collected by centrifugation at 4,000 g and were resuspended in lysis buffer (50 mM tris(hydroxymethyl)-aminomethane (Tris)-HCl (pH 7.5), 1 M NaCl, 20% glycerol, 10 mM tris(2-carboxyethyl)phosphine (TCEP, Soltec Ventures)). The cells were lysed by sonication (20 s pulse-on, 20 s pulse-off for 8 min total at 6 W output) and the lysate supernatant was isolated following centrifugation at 25,000 g for 15 minutes. The lysate was incubated with His-Pur nickel-nitriloacetic acid (nickel-NTA) resin (ThermoFisher Scientific) at 4° C. for 1 hour to capture the His-tagged fusion protein. The resin was transferred to a column and was washed with 40 ml of lysis buffer. The His-tagged fusion protein was eluted in lysis buffer supplemented with 285 mM imidazole, and concentrated by ultrafiltration (Amicon-Millipore, 100-kDa molecular weight cut-off) to 1 ml total volume. The protein was diluted to 20 ml in low-salt purification buffer containing 50 mM tris(hydroxymethyl)-aminomethane (Tris)-HCl (pH 7.0), 0.1 M NaCl, 20% glycerol, 10 mM TCEP and loaded onto SP Sepharose Fast Flow resin (GE Life Sciences). The resin was washed with 40 ml of this low-salt buffer, and the protein eluted with 5 ml of activity buffer containing 50 mM tris(hydroxymethyl)-aminomethane (Tris)-HCl (pH 7.0), 0.5 M NaCl, 20% glycerol, 10 mM TCEP. The eluted proteins were quantified by SDS-PAGE.

In Vitro Transcription of sgRNAs.

Linear DNA fragments containing the T7 promoter followed by the sgRNA target sequence were transcribed in vitro using primer sequences with the TranscriptAid T7 High Yield Transcription Kit (ThermoFisher Scientific) according to the manufacturer's instructions. sgRNA products were purified using the MEGAclear Kit (ThermoFisher Scientific) according to the manufacturer's instructions and were quantified by UV absorbance.

Preparation of Cy3-Conjugated dsDNA Substrates.

Typically, sequences of unlabelled strands, e.g., 80-nt in length, were ordered as PAGE-purified oligonucleotides from Integrated DNA Technologies (IDT). The labelled primer is complementary to the 3' end of each substrate, e.g., 80-nt substrate. The primer was ordered as an HPLC-purified oligonucleotide from IDT. To generate the Cy3-labelled dsDNA substrates, the 80-nt strands (5 µl of a 100 µM solution) were combined with the Cy3-labelled primer (5 µl of a 100 µM solution) in NEBuffer 2 (38.25 µl of a 50 mM NaCl, 10 mM Tris-HCl, 10 mM MgCl2, 1 mM DTT, pH 7.9 solution, New England Biolabs) with dNTPs (0.75 µl of a 100 mM solution) and heated to 95° C. for 5 min, followed by a gradual cooling to 45° C. at a rate of 0.1° C. per s. After this annealing period, Klenow exo-(5 U, New England Biolabs) was added and the reaction was incubated at 37° C. for 1 hour. The solution was diluted with buffer PB (250 µl, Qiagen) and isopropanol (50 µl) and purified on a QIAprep spin column (Qiagen), eluting with 50 µl of Tris buffer. Deaminase assay on dsDNA. The purified fusion protein (20 µl of 1.9 µM in activity buffer) was combined with 1 equivalent of appropriate sgRNA and incubated at ambient temperature for 5 minutes. The Cy3-labelled dsDNA substrate was added to final concentration of 125 nM and the resulting solution was incubated at 37° C. for 2 hours. The dsDNA was separated from the fusion by the addition of buffer PB (100 µl, Qiagen) and isopropanol (25 µl) and purified on a EconoSpin micro spin column (Epoch Life Science), eluting with 20 µl of CutSmart buffer (New England Biolabs). USER enzyme (1 U, New England Biolabs) was added to the purified, edited dsDNA and incubated at 37° C. for 1 hour. The Cy3-labeled strand was fully denatured from its complement by combining 5 µl of the reaction solution with 15 µl of a DMSO-based loading buffer (5 mM Tris, 0.5 mM EDTA, 12.5% glycerol, 0.02% bromophenol blue, 0.02% xylene cyan, 80% DMSO). The full-length C-containing substrate was separated from any cleaved, U-containing edited substrates on a 10% TBE-urea gel (Bio-Rad) and imaged on a GE Amersham Typhoon imager.

Preparation of In Vitro-Edited dsDNA for High-Throughput Sequencing.

The oligonucleotides were obtained from Integrated DNA Technologies (IDT). Complementary sequences were combined (5 µl of a 100 µM solution) in Tris buffer and annealed by heating to 95° C. for 5 minutes, followed by a gradual cooling to 45° C. at a rate of 0.1° C. per s to generate 60-bp dsDNA substrates. Purified fusion protein (20 µl of 1.9 µM in activity buffer) was combined with 1 equivalent of appropriate sgRNA and incubated at ambient temperature for 5 min. The 60-mer dsDNA substrate was added to final concentration of 125 nM, and the resulting solution was incubated at 37° C. for 2 h. The dsDNA was separated from the fusion by the addition of buffer PB (100 µl, Qiagen) and isopropanol (25 µl) and purified on a EconoSpin micro spin column (Epoch Life Science), eluting with 20 µl of Tris buffer. The resulting edited DNA (1 µl was used as a template) was amplified by PCR using the high-throughput sequencing primer pairs and VeraSeq Ultra (Enzymatics) according to the manufacturer's instructions with 13 cycles of amplification. PCR reaction products were purified using RapidTips (Diffinity Genomics), and the purified DNA was amplified by PCR with primers containing sequencing adapters, purified, and sequenced on a MiSeq high-throughput DNA sequencer (Illumina) as previously described.

Cell Culture.

HEK293T (ATCC CRL-3216), U2OS (ATCC HTB-96), CD34+ cells, or other relevant cell types were maintained in Dulbecco's Modified Eagle's Medium plus GlutaMax (ThermoFisher) supplemented with 10% (v/v) fetal bovine serum (FBS), at 37° C. with 5% CO2. HCC1954 cells (ATCC CRL-2338) were maintained in RPMI-1640 medium (ThermoFisher Scientific) supplemented as described above. Immortalized cells containing a gene containing the target sequence (Taconic Biosciences) were cultured in Dulbecco's Modified Eagle's Medium plus GlutaMax (ThermoFisher Scientific) supplemented with 10% (v/v) fetal bovine serum (FBS) and 200 µg ml−1 Geneticin (ThermoFisher Scientific).

Transfections.

HEK293T or other host cells were seeded on 48-well collagen-coated BioCoat plates (Corning) and transfected at approximately 85% confluency. Briefly, 750 ng of BE and 250 ng of sgRNA expression plasmids were transfected using 1.5 µl of Lipofectamine 2000 (ThermoFisher Scientific) per well according to the manufacturer's protocol. HEK293T cells were transfected using appropriate Amaxa Nucleofector II programs according to manufacturer's instructions (V kits using program Q-001 for HEK293T cells).

High-Throughput DNA Sequencing of Genomic DNA Samples

Transfected cells were harvested after 3 days and the genomic DNA was isolated using the Agencourt DNAdvance Genomic DNA Isolation Kit (Beckman Coulter) according to the manufacturer's instructions. On-target and off-target genomic regions of interest were amplified by PCR with flanking high-throughput sequencing primer pair. PCR amplification was carried out with Phusion high-fidelity DNA polymerase (ThermoFisher) according to the manufacturer's instructions using 5 ng of genomic DNA as a template. Cycle numbers were determined separately for each primer pair as to ensure the reaction was stopped in the linear range of amplification. PCR products were purified using RapidTips (Diffinity Genomics). Purified DNA was amplified by PCR with primers containing sequencing adaptors. The products were gel purified and quantified using the Quant-iT PicoGreen dsDNA Assay Kit (ThermoFisher) and KAPA Library Quantification Kit-Illumina (KAPA Biosystems). Samples were sequenced on an Illumina MiSeq as previously described (Pattanayak, Nature Biotechnol. 31, 839-843 (2013)).

Data Analysis.

Sequencing reads were automatically demultiplexed using MiSeq Reporter (Illumina), and individual FASTQ files were analysed with a custom Matlab. Each read was pairwise aligned to the appropriate reference sequence using the Smith-Waterman algorithm. Base calls with a Q-score below 31 were replaced with Ns and were thus excluded in calculating nucleotide frequencies. This treatment yields an expected MiSeq base-calling error rate of approximately 1 in 1,000. Aligned sequences in which the read and reference sequence contained no gaps were stored in an alignment table from which base frequencies could be tabulated for each locus. Indel frequencies were quantified with a custom Matlab script using previously described criteria (Zuris, et al., *Nature Biotechnol.* 33, 73-80 (2015). Sequencing reads were scanned for exact matches to two 10-bp sequences that flank both sides of a window in which indels might occur. If no exact matches were located, the read was excluded from analysis. If the length of this indel window exactly matched the reference sequence the read was classified as not containing an indel. If the indel window was two or more bases longer or shorter than the reference sequence, then the sequencing read was classified as an insertion or deletion, respectively.

Other Embodiments

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All patents and publications mentioned in this specification are herein incorporated by reference to the same extent as if each independent patent and publication was specifically and individually indicated to be incorporated by reference.

SEQUENCE LISTING (277 sequences)

SEQ ID NO: 1 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 2 - DNA, 1254 bp, Homo sapiens
atgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaa

SEQ ID NO: 3 - protein, 418 aa, Artificial Sequence [sequence omitted]

SEQ ID NO: 4 - DNA, 1254 bp, Artificial Sequence
  Description of Artificial Sequence: Synthetic polypeptide
atgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacaagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaa

SEQ ID NO: 5 - RNA, 20 nt, Artificial Sequence
  Description of Artificial Sequence: Synthetic oligonucleotide
cuucuccacaggagucagau

SEQ ID NO: 6 - RNA, 21 nt, Artificial Sequence
  Description of Artificial Sequence: Synthetic oligonucleotide
acuucuccacaggagucagau

SEQ ID NO: 7 - RNA, 22 nt, Artificial Sequence
  Description of Artificial Sequence: Synthetic oligonucleotide
gacuucuccacaggagucagau

SEQ ID NO: 8 - RNA, 20 nt, Artificial Sequence
  Description of Artificial Sequence: Synthetic oligonucleotide
uccacaggagucagaugcac

SEQ ID NO: 9 - RNA, 18 nt, Artificial Sequence
  Description of Artificial Sequence: Synthetic oligonucleotide
uucuccacaggagucaga

SEQ ID NO: 10 - RNA, 19 nt, Artificial Sequence
  Description of Artificial Sequence: Synthetic oligonucleotide
cuucuccacaggagucaga

SEQ ID NO: 11 - RNA, 20 nt, Artificial Sequence
  Description of Artificial Sequence: Synthetic oligonucleotide
acuucuccacaggagucaga

SEQ ID NO: 12 - RNA, 21 nt, Artificial Sequence
  Description of Artificial Sequence: Synthetic oligonucleotide
gacuucuccacaggagucaga

SEQ ID NO: 13 - RNA, 22 nt, Artificial Sequence
  Description of Artificial Sequence: Synthetic oligonucleotide
agacuucuccacaggagucaga

SEQ ID NO: 14 - protein, 7 aa, Artificial Sequence
  Description of Artificial Sequence: Synthetic peptide
RNEHLEV

SEQ ID NO: 15 - protein, 7 aa, Artificial Sequence
  Description of Artificial Sequence: Synthetic peptide
QSTTLKR

SEQ ID NO: 16 - protein, 7 aa, Artificial Sequence
  Description of Artificial Sequence: Synthetic peptide
RTEHLAR

SEQ ID NO: 17 - protein, 7 aa, Artificial Sequence
  Description of Artificial Sequence: Synthetic peptide
RGEHLRQ

SEQ ID NO: 18 - protein, 7 aa, Artificial Sequence
  Description of Artificial Sequence: Synthetic peptide
QSGTLKR

SEQ ID NO: 19 - protein, 7 aa, Artificial Sequence
  Description of Artificial Sequence: Synthetic peptide
RNDKLVP

SEQ ID NO: 20 - protein, 1120 aa, Streptococcus thermophilus
SDLVLGLAIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTLYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINDKGKEVPCNPFLKYKEEHGYIRKYSKKGNGPEIKSLKYYDSKLGNHIDITPKDSNNKVVLQSVSPWRADVYFNKTTGKYEILGLKYADLQFDKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 21 - protein, 24 aa, Artificial Sequence
  Description of Artificial Sequence: Synthetic peptide
SGGSSGGSSGSETPGTSESATPES

SEQ ID NO: 22 - protein, 1544 aa, Artificial Sequence
  Description of Artificial Sequence: Synthetic polypeptide
MPKKKRKVSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDLVLGLAIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTLYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINDKGKEVPCNPFLKYKEEHGYIRKYSKKGNGPEIKSLKYYDSKLGNHIDITPKDSNNKVVLQSVSPWRADVYFNKTTGKYEILGLKYADLQFDKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDFPKKKRKVEGADKRTADGSEFESPKKKRKV

SEQ ID NO: 23 - RNA, 125 nt, Artificial Sequence
  Description of Artificial Sequence: Synthetic polynucleotide
guuuuuguacucucaagauuuaaguaacuguacaacgaaacuuacacaguuacuuaaaucuugcagaagcuacaaagauaaggcuucaugccgaaaucaacacccugucauuuuauggcagggug

SEQ ID NO: 24 - RNA, 145 nt, Artificial Sequence
  Description of Artificial Sequence: Synthetic polynucleotide
cuucuccacaggagucagauguuuuuguacucucaagauuuaaguaacuguacaacgaaacuuacacaguuacuuaaaucuugcagaagcuacaaagauaaggcuucaugccgaaaucaacacccugucauuuuauggcagggug

SEQ ID NO: 25 - RNA, 146 nt, Artificial Sequence
  Description of Artificial Sequence: Synthetic polynucleotide
acuucuccacaggagucagauguuuuuguacucucaagauuuaaguaacuguacaacgaaacuuacacaguuacuuaaaucuugcagaagcuacaaagauaaggcuucaugccgaaaucaacacccugucauuuuauggcagggug

SEQ ID NO: 26 - RNA, 147 nt, Artificial Sequence
  Description of Artificial Sequence: Synthetic polynucleotide
gacuucuccacaggagucagauguuuuuguacucucaagauuuaaguaacuguacaacgaaacuuacacaguuacuuaaaucuugcagaagcuacaaagauaaggcuucaugccgaaaucaacacccugucauuuuauggcagggug

SEQ ID NO: 27 - protein, 1052 aa, Staphylococcus aureus
KRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 28 - protein, 1471 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGEGADKRTADGSEFESPKKKRKV

SEQ ID NO: 29 - protein, 1591 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGEGADKRTADGSEFESPKKKRKVSSGNSNANSRGPSFSSGLVPLSLRGSHSRPGERPFQCRICMRNFSRNEHLEVHTRTHTGEKPFQCRICMRNFSQSTTLKRHLRTHTGEKPFQCRICMRNFSRTEHLARHLKTHLRGSSAQ

SEQ ID NO: 30 - protein, 1591 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGEGADKRTADGSEFESPKKKRKVSSGNSNANSRGPSFSSGLVPLSLRGSHSRPGERPFQCRICMRNFSRGEHLRQHTRTHTGEKPFQCRICMRNFSQSGTLKRHLRTHTGEKPFQCRICMRNFSRNDKLVPHLKTHLRGSSAQ

SEQ ID NO: 31 - RNA, 90 nt, Artificial Sequence
  Description of Artificial Sequence: Synthetic oligonucleotide
guuuuaguacucuguaaugaaaauuacagaaucuacuaaaacaaggcaaaaugccguguuuaucucgucaacuuguuggcgagauuuuuu

SEQ ID NO: 32 - RNA, 110 nt, Artificial Sequence
  Description of Artificial Sequence: Synthetic polynucleotide
uccacaggagucagaugcacguuuuaguacucuguaaugaaaauuacagaaucuacuaaaacaaggcaaaaugccguguuuaucucgucaacuuguuggcgagauuuuuu

SEQ ID NO: 33 - RNA, 111 nt, Artificial Sequence
  Description of Artificial Sequence: Synthetic polynucleotide
cuccacaggagucagaugcacguuuuaguacucuguaaugaaaauuacagaaucuacuaaaacaaggcaaaaugccguguuuaucucgucaacuuguuggcgagauuuuuu

SEQ ID NO: 34 - DNA, 5514 bp, Artificial Sequence
  Description of Artificial Sequence: Synthetic polynucleotide
atgagctcagagactggcccagtggctgtggaccccacattgagacggcggatcgagccccatgagtttgaggtattcttcgatccgagagagctccgcaaggagacctgcctgctttacgaaattaattgggggggccggcactccatttggcgacatacatcacagaacactaacaagcacgtcgaagtcaacttcatcgagaagttcacgacagaaagatatttctgtccgaacacaaggtgcagcattacctggtttctcagctggagcccatgcggcgaatgtagtagggccatcactgaattcctgtcaaggtatccccacgtcactctgtttatttacatcgcaaggctgtaccaccacgctgacccccgcaatcgacaaggcctgcgggatttgatctcttcaggtgtgactatccaaattatgactgagcaggagtcaggatactgctggagaaactttgtgaattatagcccgagtaatgaagcccactggcctaggtatccccatctgtgggtacgactgtacgttcttgaactgtactgcatcatactgggcctgcctccttgtctcaacattctgagaaggaagcagccacagctgacattctttaccatcgctcttcagtcttgtcattaccagcgactgcccccacacattctctgggccaccgggttgaaatctggtggttcttctggtggttctagcggcagcgagactcccgggacctcagagtccgccacacccgaaagttctggtggttcttctggtggttctgataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgactctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctaaaaggacggcggacggatcagagttcgagagtccgaaaaaaaaacgaaaggtcgaataa

SEQ ID NO: 35 - DNA, 5514 bp, Artificial Sequence
  Description of Artificial Sequence: Synthetic polynucleotide
atgtcatccgaaaccgggccagtggccgtagacccaacactcaggaggcggatagaaccccatgagtttgaagtgttcttcgaccccagagagctgcgcaaagagacttgcctcctgtatgaaataaattgggggggtcgccattcaatttggaggcacactagccagaatactaacaaacacgtggaggtaaattttatcgagaagtttaccaccgaaagatacttttgccccaatacacggtgttcaattacctggtttctgtcatggagtccatgtggagaatgtagtagagcgataactgagttcctgtctcgatatcctcacgtcacgttgtttatatacatcgctcggctttatcaccatgcggacccgcggaacaggcaaggtcttcgggacctcatatcctctggggtgaccatccagataatgacggagcaagagagcggatactgctggcgaaactttgttaactacagcccaagcaatgaggcacactggcctagatatccgcatctctgggttcgactgtatgtccttgaactgtactgcataattctgggacttccgccatgcttgaacattctgcggcggaaacaaccacagctgacctttttcacgattgctctccaaagttgtcactaccagcgattgccaccccacatcttgtgggctactggactcaagtctggaggaagttcaggcggaagcagcgggtctgaaacgcccggaacctcagagagcgcaacgcccgaaagctctggagggtcaagtggtggtagtgataagaaatactccatcggcctcgccatcggtacgaattctgtcggttgggccgttatcaccgatgagtacaaggtcccttctaagaaattcaaggttttgggcaatacagaccgccattctataaaaaaaaacctgatcggcgcccttttgtttgacagtggtgagactgctgaagcgactcgcctgaagcgaactgccaggaggcggtatacgaggcgaaaaaaccgaatttgttacctccaggagattttctcaaatgaaatggccaaggtagatgatagtttttttcaccgcttggaagaaagttttctcgttgaggaggacaaaaagcacgagaggcacccaatctttggcaacatagtcgatgaggtcgcataccatgagaaatatcctacgatctatcatctccgcaagaagctggtcgatagcacggataaagctgacctccggctgatctaccttgctcttgctcacatgattaaattcaggggccatttcctgatagaaggagacctcaatcccgacaattctgatgtcgacaaactgtttattcagctcgttcagacctataatcaactctttgaggagaaccccatcaatgcttcaggggtggacgcaaaggccattttgtccgcgcgcttgagtaaatcacgacgcctcgagaatttgatagctcaactgccgggtgagaagaaaaacgggttgtttgggaatctcatagcgttgagtttgggacttacgccaaactttaagtctaactttgatttggccgaagatgccaaattgcagctgtccaaagatacctatgatgacgacttggataaccttcttgcgcagattggtgaccaatacgcggatctgtttcttgccgcaaaaaatctgtccgacgccatactcttgtccgatatactgcgcgtcaatactgagataactaaggctcccctcagcgcgtccatgattaaaagatacgatgagcaccaccaagatctcactctgttgaaagccctggttcgccagcagcttccagagaagtataaggagatatttttcgaccaatctaaaaacggctatgcgggttacattgacggtggcgcctctcaagaagaattctacaagtttataaagccgatacttgagaaaatggacggtacagaggaattgttggttaagctcaatcgcgaggacttgttgagaaagcagcgcacatttgacaatggtagtattccacaccagattcatctgggcgagttgcatgccattcttagaagacaagaagatttttatccgtttctgaaagataacagagaaaagattgaaaagatacttacctttcgcataccgtattatgtaggtcccctggctagagggaacagtcgcttcgcttggatgactcgaaaatcagaagaaacaataaccccctggaattttgaagaagtggtagataaaggtgcgagtgcccaatcttttattgagcggatgacaaattttgacaagaatctgcctaacgaaaaggtgcttcccaagcattcccttttgtatgaatactttacagtatataatgaactgactaaagtgaagtacgttaccgaggggatgcgaaagccagcttttctcagtggcgagcagaaaaaagcaatagttgacctgctgttcaagacgaataggaaggttaccgtcaaacagctcaaagaagattactttaaaaagatcgaatgttttgattcagttgagataagcggagtagaggatagatttaacgcaagtcttggaacttatcatgaccttttgaagatcatcaaggataaagattttttggacaacgaggagaatgaagatatcctggaagatatagtacttaccttgacgctttttgaagatcgagagatgatcgaggagcgacttaagacgtacgcacatctctttgacgataaggttatgaaacaattgaaacgccggcggtatactggctggggcaggctttctcgaaagctgattaatggtatccgcgataagcagtctggaaagacaatccttgactttctgaaaagtgatggatttgcaaatagaaactttatgcagcttatacatgatgactctttgacgttcaaggaagacatccagaaggcacaggtatccggccaaggggatagcctccatgaacacatagccaacctggccggctcaccagctattaaaaagggaatattgcaaaccgttaaggttgttgacgaactcgttaaggttatgggccgacacaaaccagagaatatcgtgattgagatggctagggagaatcagaccactcaaaaaggtcagaaaaattctcgcgaaaggatgaagcgaattgaagagggaatcaaagaacttggctctcaaattttgaaagagcacccggtagaaaacactcagctgcagaatgaaaagctgtatctgtattatctgcagaatggtcgagatatgtacgttgatcaggagctggatatcaataggctcagtgactacgatgtcgaccacatcgttcctcaatctttcctgaaagatgactctatcgacaacaaagtgttgacgcgatcagataagaaccggggaaaatccgacaatgtaccctcagaagaagttgtcaagaagatgaaaaactattggagacaattgctgaacgccaagctcataacacaacgcaagttcgataacttgacgaaagccgaaagaggtgggttgtcagaattggacaaagctggctttattaagcgccaattggtggagacccggcagattacgaaacacgtagcacaaattttggattcacgaatgaataccaaatacgacgaaaacgacaaattgatacgcgaggtgaaagtgattacgcttaagagtaagttggtttccgatttcaggaaggattttcagttttacaaagtaagagaaataaacaactaccaccacgcccatgatgcttacctcaacgcggtagttggcacagctcttatcaaaaaatatccaaagctggaaagcgagttcgtttacggtgactataaagtatacgacgttcggaagatgatagccaaatcagagcaggaaattgggaaggcaaccgcaaaatacttcttctattcaaacatcatgaacttctttaagacggagattacgctcgcgaacggcgaaatacgcaagaggcccctcatagagactaacggcgaaaccggggagatcgtatgggacaaaggacgggactttgcgaccgttagaaaagtactttcaatgccacaagtgaatattgttaaaaagacagaagtacaaacaggggggttcagtaaggaatccattttgcccaagcggaacagtgataaattgatagcaaggaaaaaagattgggaccctaagaagtacggtggtttcgactctcctaccgttgcatattcagtccttgtagttgcgaaagtggaaaaggggaaaagtaagaagcttaagagtgttaaagagcttctgggcataaccataatggaacggtctagcttcgagaaaaatccaattgactttctcgaggctaaaggttacaaggaggtaaaaaaggacctgataattaaactcccaaagtacagtctcttcgagttggagaatgggaggaagagaatgttggcatctgcaggggagctccaaaaggggaacgagctggctctgccttcaaaatacgtgaactttctgtacctggccagccactacgagaaactcaagggttctcctgaggataacgagcagaaacagctgtttgtagagcagcacaagcattacctggacgagataattgagcaaattagtgagttctcaaaaagagtaatccttgcagacgcgaatctggataaagttctttccgcctataataagcaccgggacaagcctatacgagaacaagccgagaacatcattcacctctttacccttactaatctgggcgcgccggccgccttcaaatacttcgacaccacgatagacaggaaaaggtatacgagtaccaaagaagtacttgacgccactctcatccaccagtctataacagggttgtacgaaacgaggatagatttgtcccagctcggcggcgactcaggagggtcaggcggctccggtggatcaacgaatctttccgacataatcgagaaagaaaccggcaaacagttggtgatccaagaatcaatcctgatgctgcctgaagaagtagaagaggtgattggcaacaaacctgagtctgacattcttgtccacaccgcgtatgacgagagcacggacgagaacgttatgcttctcactagcgacgcccctgagtataaaccatgggcgctggtcatccaagattccaatggggaaaacaagattaagatgcttagtggtgggtctggagggagcggtgggtccacgaacctcagcgacattattgaaaaagagactggtaaacaacttgtaatacaagagtctattctgatgttgcctgaagaggtggaggaggtgattgggaacaaaccggagtctgatatacttgttcataccgcctatgacgaatctactgatgagaatgtgatgcttttaacgtcagacgctcccgagtacaaaccctgggctctggtgattcaggacagcaatggtgagaataagattaaaatgttgagtgggggctcaaagcgcacggctgacggtagcgaatttgagagccccaaaaaaaaacgaaaggtcgaataa

SEQ ID NO: 36 - DNA, 5514 bp, Artificial Sequence
  Description of Artificial Sequence: Synthetic polynucleotide
atgagcagcgagacaggccctgtggctgtggatcctacactgcggagaagaatcgagccccacgagttcgaggtgttcttcgaccccagagagctgcggaaagagacatgcctgctgtacgagatcaactggggcggcagacactctatctggcggcacacaagccagaacaccaacaagcacgtggaagtgaactttatcgagaagtttacgaccgagcggtacttctgccccaacaccagatgcagcatcacctggtttctgagctggtccccttgcggcgagtgcagcagagccatcaccgagtttctgtccagatatccccacgtgaccctgttcatctatatcgcccggctgtaccaccacgccgatcctagaaatagacagggactgcgcgacctgatcagcagcggagtgaccatccagatcatgaccgagcaagagagcggctactgctggcggaacttcgtgaactacagccccagcaacgaagcccactggcctagatatcctcacctgtgggtccgactgtacgtgctggaactgtactgcatcatcctgggcctgcctccatgcctgaacatcctgagaagaaagcagcctcagctgaccttcttcacaatcgccctgcagagctgccactaccagagactgcctccacacatcctgtgggccaccggacttaagagcggaggatctagcggcggctctagcggatctgagacacctggcacaagcgagtctgccacacctgagagtagcggcggatcttctggcggctccgacaagaagtactctatcggactggccatcggcaccaactctgttggatgggccgtgatcaccgacgagtacaaggtgcccagcaagaaattcaaggtgctgggcaacaccgaccggcacagcatcaagaagaatctgatcggcgccctgctgttcgactctggcgaaacagccgaagccaccagactgaagagaaccgccaggcggagatacacccggcggaagaaccggatctgctacctgcaagagatcttcagcaacgagatggccaaggtggacgacagcttcttccacagactggaagagtccttcctggtggaagaggacaagaagcacgagcggcaccccatcttcggcaacatcgtggatgaggtggcctaccacgagaagtaccccaccatctaccacctgagaaagaaactggtggacagcaccgacaaggccgacctgagactgatctacctggctctggcccacatgatcaagttccggggccactttctgatcgagggcgatctgaaccccgacaacagcgacgtggacaagctgttcatccagctggtgcagacctacaaccagctgttcgaggaaaaccccatcaacgcctctggcgtggacgccaaggctatcctgtctgccagactgagcaagagcagaaggctggaaaacctgatcgcccagctgcctggcgagaagaagaatggcctgttcggcaacctgattgccctgagcctgggactgacccctaacttcaagagcaacttcgacctggccgaggatgccaaactgcagctgagcaaggacacctacgacgacgacctggacaatctgctggcccagatcggcgatcagtacgccgacttgtttctggccgccaagaacctgtccgacgccatcctgctgagcgatatcctgagagtgaacaccgagatcacaaaggcccctctgagcgcctctatgatcaagagatacgacgagcaccaccaggatctgaccctgctgaaggccctcgttagacagcagctgccagagaagtacaaagagattttcttcgatcagtccaagaacggctacgccggctacattgatggcggagccagccaagaggaattctacaagttcatcaagcccatcctggaaaagatggacggcaccgaggaactgctggtcaagctgaacagagaggacctgctgcggaagcagcggaccttcgacaatggctctatccctcaccagatccacctgggagagctgcacgccattctgcggagacaagaggacttttacccattcctgaaggacaaccgggaaaagatcgagaagatcctgaccttcaggatcccctactacgtgggaccactggccagaggcaatagcagattcgcctggatgaccagaaagagcgaggaaaccatcacaccctggaacttcgaggaagtggtggacaagggcgccagcgctcagtccttcatcgagcggatgaccaacttcgataagaacctgcctaacgagaaggtgctgcccaagcactccctgctgtatgagtacttcaccgtgtacaacgagctgaccaaagtgaaatacgtgaccgagggaatgagaaagcccgcctttctgagcggcgagcagaaaaaggccattgtggatctgctgttcaagaccaaccggaaagtgaccgtgaagcagctgaaagaggactacttcaagaaaatcgagtgcttcgacagcgtggaaatcagcggcgtggaagatcggttcaatgccagcctgggcacataccacgacctgctgaaaattatcaaggacaaggacttcctggacaacgaagagaacgaggacattctcgaggacatcgtgctgaccctgacactgtttgaggacagagagatgatcgaggaacggctgaaaacatacgcccacctgttcgacgacaaagtgatgaagcaactgaagcggaggcggtacacaggctggggcagactgtctcggaagctgatcaacggcatccgggataagcagtccggcaagacaatcctggatttcctgaagtccgacggcttcgccaacagaaacttcatgcagctgatccacgacgacagcctgacctttaaagaggacatccagaaagcccaggtgtccggccaaggcgattctctgcacgagcacattgccaacctggccggatctcccgccattaagaagggcatcctgcagacagtgaaggtggtggacgagcttgtgaaagtgatgggcagacacaagcccgagaacatcgtgatcgaaatggccagagagaaccagaccacacagaagggccagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaaccggctgagcgactacgatgtggaccatatcgtgccccagagctttctgaaggacgactccatcgataacaaggtcctgaccagaagcgacaagaaccggggcaagagcgataacgtgccctccgaagaggtggtcaagaagatgaagaactactggcgacagctgctgaacgccaagctgattacccagcggaagttcgataacctgaccaaggccgagagaggcggcctgagcgaacttgataaggccggcttcattaagcggcagctggtggaaacccggcagatcaccaaacacgtggcacagattctggactcccggatgaacactaagtacgacgagaatgacaagctgatccgggaagtgaaagtcatcaccctgaagtctaagctggtgtccgatttccggaaggatttccagttctacaaagtgcgggaaatcaacaactaccatcacgcccacgacgcctacctgaatgccgttgttggaacagccctgatcaagaagtatcccaagctggaaagcgagttcgtgtacggcgactacaaggtgtacgacgtgcggaagatgatcgccaagagcgaacaagagatcggcaaggctaccgccaagtactttttctacagcaacatcatgaactttttcaagacagagatcaccctggccaacggcgagatccggaaaagacccctgatcgagacaaacggcgaaaccggggagatcgtgtgggataagggcagagattttgccacagtgcggaaagtgctgagcatgccccaagtgaatatcgtgaagaaaaccgaggtgcagacaggcggcttcagcaaagagtctatcctgcctaagcggaacagcgataagctgatcgccagaaagaaggactgggaccctaagaagtacggcggcttcgatagccctaccgtggcctattctgtgctggtggtggccaaagtggaaaagggcaagtccaaaaagctcaagagcgtgaaagagctgctggggatcaccatcatggaaagaagcagctttgagaagaacccgatcgactttctggaagccaagggctacaaagaagtcaagaaggacctcatcatcaagctccccaagtacagcctgttcgagctggaaaatggccggaagcggatgctggcctcagcaggcgaactgcagaaaggcaatgaactggccctgcctagcaaatacgtcaacttcctgtacctggccagccactatgagaagctgaagggcagccccgaggacaatgagcaaaagcagctgtttgtggaacagcacaagcactacctggacgagatcatcgagcagatcagcgagttctccaagagagtgatcctggccgacgctaacctggataaggtgctgtctgcctataacaagcaccgggacaagcctatcagagagcaggccgagaatatcatccacctgtttaccctgaccaacctgggagcccctgccgccttcaagtacttcgacaccaccatcgaccggaagaggtacaccagcaccaaagaggtgctggacgccacactgatccaccagtctatcaccggcctgtacgaaacccggatcgacctgtctcagctcggcggcgattctggtggttctggcggaagtggcggatccaccaatctgagcgacatcatcgaaaaagagacaggcaagcagctcgtgatccaagaatccatcctgatgctgcctgaagaggttgaggaagtgatcggcaacaagcctgagtccgacatcctggtgcacaccgcctacgatgagagcaccgatgagaacgtcatgctgctgacaagcgacgcccctgagtacaagccttgggctctcgtgattcaggacagcaatggggagaacaagatcaagatgctgagcggaggtagcggaggcagtggcggaagcacaaacctgtctgatatcattgaaaaagaaaccgggaagcaactggtcattcaagagtccattctcatgctcccggaagaagtcgaggaagtcattggaaacaaacccgagagcgatattctggtccacacagcctatgacgagtctacagacgaaaacgtgatgctcctgacctctgacgctcccgagtataagccctgggcacttgttatccaggactctaacggggaaaacaaaatcaaaatgttgtccggcggcagcaagcggacagccgatggatctgagttcgagagccccaagaagaaacggaaggtggagtaa

SEQ ID NO: 37 - protein, 147 aa, Homo sapiens
MVHLTPEEKSAVTALWGKVNVDEVGGEALGRLLVVYPWTQRFFESFGDLSTPDAVMGNPKVKAHGKKVLGAFSDGLAHLDNLKGTFATLSELHCDKLHVDPENFRLLGNVLVCVLAHHFGKEFTPPVQAAYQKVVAGVANALAHKYH

SEQ ID NO: 38 - DNA, 628 bp, Homo sapiens
acatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaa

SEQ ID NO: 39 - protein, 147 aa, Homo sapiens
MGHFTEEDKATITSLWGKVNVEDAGGETLGRLLVVYPWTQRFFDSFGNLSSASAIMGNPKVKAHGKKVLTSLGDATKHLDDLKGTFAQLSELHCDKLHVDPENFKLLGNVLVTVLAIHFGKEFTPEVQASWQKMVTAVASALSSRYH

SEQ ID NO: 40 - DNA, 584 bp, Homo sapiens
acactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatcac

SEQ ID NO: 41 - protein, 147 aa, Homo sapiens
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMVTGVASALSSRYH

SEQ ID NO: 42 - DNA, 586 bp, Homo sapiens
acactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatcaaataataaatctattctgctaagagatcacaca

SEQ ID NO: 43 - protein, 640 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 44 - DNA, 2375 bp, Homo sapiens
aggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtg

SEQ ID NO: 45 - protein, 835 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 46 - DNA, 2508 bp, Homo sapiens
atgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatag

SEQ ID NO: 47 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 48 - protein, 16 aa, Artificial Sequence
  Description of Artificial Sequence: Synthetic peptide
SGSETPGTSESATPES

SEQ ID NO: 49 - protein, 4 aa, Artificial Sequence
  Description of Artificial Sequence: Synthetic peptide
SGGS

SEQ ID NO: 50 - protein, 120 aa, Artificial Sequence
  Description of Artificial Sequence: Synthetic polypeptide
  MISC_FEATURE (1)..(120): This sequence may encompass 1-30 "Ser Gly Gly Ser" repeating units
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 51 - protein, 120 aa, Artificial Sequence
  Description of Artificial Sequence: Synthetic polypeptide
  MISC_FEATURE (1)..(120): This sequence may encompass 1-30 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 52 - protein, 150 aa, Artificial Sequence
  Description of Artificial Sequence: Synthetic polypeptide
  MISC_FEATURE (1)..(150): This sequence may encompass 1-30 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 53 - protein, 30 aa, Artificial Sequence
  Description of Artificial Sequence: Synthetic polypeptide
  MISC_FEATURE (1)..(30): This sequence may encompass 1-30 residues
GGGGGGGGGGGGGGGGGGGGGGGGGGGGGG

SEQ ID NO: 54 - protein, 150 aa, Artificial Sequence
  Description of Artificial Sequence: Synthetic polypeptide
  MISC_FEATURE (1)..(150): This sequence may encompass 1-30 "Glu Ala Ala Ala Lys" repeating units
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 55 - protein, 90 aa, Artificial Sequence
  Description of Artificial Sequence: Synthetic polypeptide
  MISC_FEATURE (1)..(90): This sequence may encompass 1-30 "Gly Gly Ser" repeating units
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 56 - protein, 60 aa, Artificial Sequence
  Description of Artificial Sequence: Synthetic polypeptide
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
  MISC_FEATURE (1)..(60): This sequence may encompass 1-30 "Xaa Pro" repeating units
XPXPXPXPXPXPXPXPXPXPXPXPXPXPXPXPXPXPXPXPXPXPXPXPXPXPXPXPXPXP

SEQ ID NO: 57 - protein, 5 aa, Artificial Sequence
  Description of Artificial Sequence: Synthetic peptide
PAPAP

SEQ ID NO: 58 - protein, 6 aa, Artificial Sequence
  Description of Artificial Sequence: Synthetic peptide
PAPAPA

SEQ ID NO: 59 - protein, 7 aa, Artificial Sequence
  Description of Artificial Sequence: Synthetic peptide
PAPAPAP

SEQ ID NO: 60 - protein, 8 aa, Artificial Sequence
  Description of Artificial Sequence: Synthetic peptide
PAPAPAPA

SEQ ID NO: 61 - protein, 9 aa, Artificial Sequence
  Description of Artificial Sequence: Synthetic peptide
PAPAPAPAP

SEQ ID NO: 62 - protein, 15 aa, Artificial Sequence
  Description of Artificial Sequence: Synthetic peptide
PAPAPAPAPAPAPAP

SEQ ID NO: 63 - protein, 21 aa, Artificial Sequence
  Description of Artificial Sequence: Synthetic peptide
PAPAPAPAPAPAPAPAPAPAP

SEQ ID NO: 64 - protein, 24 aa, Artificial Sequence
  Description of Artificial Sequence: Synthetic peptide
SGGSSGSETPGTSESATPESSGGS

SEQ ID NO: 65 - protein, 32 aa, Artificial Sequence
  Description of Artificial Sequence: Synthetic polypeptide
SGGSSGGSSGSETPGTSESATPESSGGSSGGS

SEQ ID NO: 66 - RNA, 24 nt, Homo sapiens
gugcaccugacuccugcggagaag

SEQ ID NO: 67 - protein, 8 aa, Homo sapiens
VHLTPAEK

SEQ ID NO: 68 - protein, 40 aa, Artificial Sequence
  Description of Artificial Sequence: Synthetic polypeptide
SGGSSGGSSGSETPGTSESATPESSGGSSGGSSGGSSGGS

SEQ ID NO: 69 - protein, 64 aa, Artificial Sequence
  Description of Artificial Sequence: Synthetic polypeptide
SGGSSGGSSGSETPGTSESATPESSGGSSGGSSGGSSGGSSGSETPGTSESATPESSGGSSGGS

SEQ ID NO: 70 - protein, 92 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 71 - protein, 18 aa, Artificial Sequence
  Description of Artificial Sequence: Synthetic peptide
KRTADGSEFESPKKKRKV

SEQ ID NO: 72 - protein, 16 aa, Artificial Sequence
  Description of Artificial Sequence: Synthetic peptide
KRPAATKKAGQAKKKK

SEQ ID NO: 73 - protein, 17 aa, Artificial Sequence
  Description of Artificial Sequence: Synthetic peptide
KKTELQTTNAENKTKKL

SEQ ID NO: 74 - protein, 19 aa, Artificial Sequence
  Description of Artificial Sequence: Synthetic peptide
KRGINDRNFWRGENGRKTR

SEQ ID NO: 75 - protein, 16 aa, Artificial Sequence
  Description of Artificial Sequence: Synthetic peptide
RKSGKIAAIVVKRPRK

SEQ ID NO: 76 - protein, 7 aa, Artificial Sequence
  Description of Artificial Sequence: Synthetic peptide
PKKKRKV

SEQ ID NO: 77 - protein, 30 aa, Artificial Sequence
  Description of Artificial Sequence: Synthetic polypeptide
MDSLLMNRRKFLYQFKNVRWAKGRRETYLC

SEQ ID NO: 78 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 79 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 80 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 81 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 82 - protein, 1368 aa, Streptococcus pyogenes [sequence omitted]

SEQ ID NO: 83 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 84 - protein, 1368 aa, Streptococcus pyogenes; identical to SEQ ID NO: 80

SEQ ID NO: 85 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 86 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 87 - protein, 987 aa, Unknown
  Description of Unknown: Deltaproteobacteria CasX sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPVKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDFAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITYADMDVMLVRLKKTSDGWATTLNNKELKAEYQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 88 - protein, 1210 aa, Unknown
  Description of Unknown: Uncultured Parcubacteria group bacterium
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 89 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 90 - protein, 1140 aa, Bacillus hisashii
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKK

SEQ ID NO: 91 - protein, 1112 aa, Bacillus sp.
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 92 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 93 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 94 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 95 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 96 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 97 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 98 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 99 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 100 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 101 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 102 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 103 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 104 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 105 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 106 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 107 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 108 - protein, 1359 aa, Artificial Sequence
  Description of Artificial Sequence: Synthetic polypeptide
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 109 - protein, 29 aa, Artificial Sequence
  Description of Artificial Sequence: Synthetic peptide
PKKKRKVEGADKRTADGSEFESPKKKRKV

SEQ ID NO: 110 - protein, 23 aa, Artificial Sequence
  Description of Artificial Sequence: Synthetic peptide
RKSGKIAAIVVKRPRKPKKKRKV

SEQ ID NO: 111 - protein, 16 aa, Artificial Sequence
  Description of Artificial Sequence: Synthetic peptide
KRPAATKKAGQAKKKK

SEQ ID NO: 112 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 113 - DNA, 766 bp, Petromyzon marinus
tgacacgacacagccgtgtatatgaggaagggtagctggatggggggggggggaatacgttcagagaggacattagcgagcgtcttgttggtggccttgagtctagacacctgcagacatgaccgacgctgagtacgtgagaatccatgagaagttggacatctacacgtttaagaaacagtttttcaacaacaaaaaatccgtgtcgcatagatgctacgttctctttgaattaaaacgacggggtgaacgtagagcgtgtttttggggctatgctgtgaataaaccacagagcgggacagaacgtggaattcacgccgaaatctttagcattagaaaagtcgaagaatacctgcgcgacaaccccggacaattcacgataaattggtactcatcctggagtccttgtgcagattgcgctgaaaagatcttagaatggtataaccaggagctgcgggggaacggccacactttgaaaatctgggcttgcaaactctattacgagaaaaatgcgaggaatcaaattgggctgtggaacctcagagataacggggttgggttgaatgtaatggtaagtgaacactaccaatgttgcaggaaaatattcatccaatcgtcgcacaatcaattgaatgagaatagatggcttgagaagactttgaagcgagctgaaaaacgacggagcgagttgtccattatgattcaggtaaaaatactccacaccactaagagtcctgctgtttaagaggctatgcggatggttttc

SEQ ID NO: 114 - protein, 145 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKAPV

SEQ ID NO: 115 - DNA, 10681 bp, Homo sapiens
agagaaccatcattaattgaagtgagatttttctggcctgagacttgcagggaggcaagaagacactctggacaccactatggacaggtaaagaggcagtcttctcgtgggtgattgcactggccttcctctcagagcaaatctgagtaatgagactggtagctatccctttctctcatgtaactgtctgactgataagatcagcttgatcaatatgcatatatattttttgatctgtctccttttcttctattcagatcttatacgctgtcagcccaattctttctgtttcagacttctcttgatttccctctttttcatgtggcaaaagaagtagtgcgtacaatgtactgattcgtcctgagatttgtaccatggttgaaactaatttatggtaataatattaacatagcaaatctttagagactcaaatcatgaaaaggtaatagcagtactgtactaaaaacggtagtgctaattttcgtaataattttgtaaatattcaacagtaaaacaacttgaagacacactttcctagggaggcgttactgaaataatttagctatagtaagaaaatttgtaattttagaaatgccaagcattctaaattaattgcttgaaagtcactatgattgtgtccattataaggagacaaattcattcaagcaagttatttaatgttaaaggcccaattgttaggcagttaatggcacttttactattaactaatctttccatttgttcagacgtagcttaacttacctcttaggtgtgaatttggttaaggtcctcataatgtctttatgtgcagtttttgataggttattgtcatagaacttattctattcctacatttatgattactatggatgtatgagaataacacctaatccttatactttacctcaatttaactcctttataaagaacttacattacagaataaagattttttaaaaatatatttttttgtagagacagggtcttagcccagccgaggctggtctctaagtcctggcccaagcgatcctcctgcctgggcctcctaaagtgctggaattatagacatgagccatcacatccaatatacagaataaagatttttaatggaggatttaatgttcttcagaaaattttcttgaggtcagacaatgtcaaatgtctcctcagtttacactgagattttgaaaacaagtctgagctataggtccttgtgaagggtccattggaaatacttgttcaaagtaaaatggaaagcaaaggtaaaatcagcagttgaaattcagagaaagacagaaaaggagaaaagatgaaattcaacaggacagaagggaaatatattatcattaaggaggacagtatctgtagagctcattagtgatggcaaaatgacttggtcaggattatttttaacccgcttgtttctggtttgcacggctggggatgcagctagggttctgcctcagggagcacagctgtccagagcagctgtcagcctgcaagcctgaaacactccctcggtaaagtccttcctactcaggacagaaatgacgagaacagggagctggaaacaggcccctaaccagagaagggaagtaatggatcaacaaagttaactagcaggtcaggatcacgcaattcatttcactctgactggtaacatgtgacagaaacagtgtaggcttattgtattttcatgtagagtaggacccaaaaatccacccaaagtcctttatctatgccacatccttcttatctatacttccaggacactttttcttccttatgataaggctctctctctctccacacacacacacacacacacacacacacacacacacacacacacaaacacacaccccgccaaccaaggtgcatgtaaaaagatgtagattcctctgcctttctcatctacacagcccaggagggtaagttaatataagagggatttattggtaagagatgatgcttaatctgtttaacactgggcctcaaagagagaatttcttttcttctgtacttattaagcacctattatgtgttgagcttatatatacaaagggttattatatgctaatatagtaatagtaatggtggttggtactatggtaattaccataaaaattattatccttttaaaataaagctaattattattggatcttttttagtattcattttatgttttttatgtttttgattttttaaaagacaatctcaccctgttacccaggctggagtgcagtggtgcaatcatagctttctgcagtcttgaactcctgggctcaagcaatcctcctgccttggcctcccaaagtgttgggatacagtcatgagccactgcatctggcctaggatccatttagattaaaatatgcattttaaattttaaaataatatggctaatttttaccttatgtaatgtgtatactggcaataaatctagtttgctgcctaaagtttaaagtgctttccagtaagcttcatgtacgtgaggggagacatttaaagtgaaacagacagccaggtgtggtggctcacgcctgtaatcccagcactctgggaggctgaggtgggtggatcgcttgagccctggagttcaagaccagcctgagcaacatggcaaaacgctgtttctataacaaaaattagccgggcatggtggcatgtgcctgtggtcccagctactagggggctgaggcaggagaatcgttggagcccaggaggtcaaggctgcactgagcagtgcttgcgccactgcactccagcctgggtgacaggaccagaccttgcctcaaaaaaataagaagaaaaattaaaaataaatggaaacaactacaaagagctgttgtcctagatgagctacttagttaggctgatattttggtatttaacttttaaagtcagggtctgtcacctgcactacattattaaaatatcaattctcaatgtatatccacacaaagactggtacgtgaatgttcatagtacctttattcacaaaaccccaaagtagagactatccaaatatccatcaacaagtgaacaaataaacaaaatgtgctatatccatgcaatggaataccaccctgcagtacaaagaagctacttggggatgaatcccaaagtcatgacgctaaatgaaagagtcagacatgaaggaggagataatgtatgccatacgaaattctagaaaatgaaagtaacttatagttacagaaagcaaatcagggcaggcatagaggctcacacctgtaatcccagcactttgagaggccacgtgggaagattgctagaactcaggagttcaagaccagcctgggcaacacagtgaaactccattctccacaaaaatgggaaaaaaagaaagcaaatcagtggttgtcctgtggggaggggaaggactgcaaagagggaagaagctctggtggggtgagggtggtgattcaggttctgtatcctgactgtggtagcagtttggggtgtttacatccaaaaatattcgtagaattatgcatcttaaatgggtggagtttactgtatgtaaattatacctcaatgtaagaaaaaataatgtgtaagaaaactttcaattctcttgccagcaaacgttattcaaattcctgagccctttacttcgcaaattctctgcacttctgccccgtaccattaggtgacagcactagctccacaaattggataaatgcatttctggaaaagactagggacaaaatccaggcatcacttgtgctttcatatcaaccatgctgtacagcttgtgttgctgtctgcagctgcaatggggactcttgatttctttaaggaaacttgggttaccagagtatttccacaaatgctattcaaattagtgcttatgatatgcaagacactgtgctaggagccagaaaacaaagaggaggagaaatcagtcattatgtgggaacaacatagcaagatatttagatcattttgactagttaaaaaagcagcagagtacaaaatcacacatgcaatcagtataatccaaatcatgtaaatatgtgcctgtagaaagactagaggaataaacacaagaatcttaacagtcattgtcattagacactaagtctaattattattattagacactatgatatttgagatttaaaaaatctttaatattttaaaatttagagctcttctatttttccatagtattcaagtttgacaatgatcaagtattactctttctttttttttttttttttttttttttgagatggagttttggtcttgttgcccatgctggagtggaatggcatgaccatagctcactgcaacctccacctcctgggttcaagcaaagctgtcgcctcagcctcccgggtagatgggattacaggcgcccaccaccacactcggctaatgtttgtatttttagtagagatggggtttcaccatgttggccaggctggtctcaaactcctgacctcagaggatccacctgcctcagcctcccaaagtgctgggattacagatgtaggccactgcgcccggccaagtattgctcttatacattaaaaaacaggtgtgagccactgcgcccagccaggtattgctcttatacattaaaaaataggccggtgcagtggctcacgcctgtaatcccagcactttgggaagccaaggcgggcagaacacccgaggtcaggagtccaaggccagcctggccaagatggtgaaaccccgtctctattaaaaatacaaacattacctgggcatgatggtgggcgcctgtaatcccagctactcaggaggctgaggcaggaggatccgcggagcctggcagatctgcctgagcctgggaggttgaggctacagtaagccaagatcatgccagtatacttcagcctgggcgacaaagtgagaccgtaacaaaaaaaaaaaaatttaaaaaaagaaatttagatcaagatccaactgtaaaaagtggcctaaacaccacattaaagagtttggagtttattctgcaggcagaagagaaccatcagggggtcttcagcatgggaatggcatggtgcacctggtttttgtgagatcatggtggtgacagtgtggggaatgttattttggagggactggaggcagacagaccggttaaaaggccagcacaacagataaggaggaagaagatgagggcttggaccgaagcagagaagagcaaacagggaaggtacaaattcaagaaatattggggggtttgaatcaacacatttagatgattaattaaatatgaggactgaggaataagaaatgagtcaaggatggttccaggctgctaggctgcttacctgaggtggcaaagtcgggaggagtggcagtttaggacagggggcagttgaggaatattgttttgatcattttgagtttgaggtacaagttggacacttaggtaaagactggaggggaaatctgaatatacaattatgggactgaggaacaagtttattttattttttgtttcgttttcttgttgaagaacaaatttaattgtaatcccaagtcatcagcatctagaagacagtggcaggaggtgactgtcttgtgggtaagggtttggggtccttgatgagtatctctcaattggccttaaatataagcaggaaaaggagtttatgatggattccaggctcagcagggctcaggagggctcaggcagccagcagaggaagtcagagcatcttctttggtttagcccaagtaatgacttccttaaaaagctgaaggaaaatccagagtgaccagattataaactgtactcttgcattttctctccctcctctcacccacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataaggtatcaattaaagtcggctttgcaagcagtttaatggtcaactgtgagtgcttttagagccacctgctgatggtattacttccatccttttttggcatttgtgtctctatcacattcctcaaatccttttttttatttctttttccatgtccatgcacccatattagacatggcccaaaatatgtgatttaattcctccccagtaatgctgggcaccctaataccactccttccttcagtgccaagaacaactgctcccaaactgtttaccagctttcctcagcatctgaattgcctttgagattaattaagctaaaagcatttttatatgggagaatattatcagcttgtccaagcaaaaattttaaatgtgaaaaacaaattgtgtcttaagcatttttgaaaattaaggaagaagaatttgggaaaaaattaacggtggctcaattctgtcttccaaatgatttcttttccctcctactcacatgggtcgtaggccagtgaatacattcaacatggtgatccccagaaaactcagagaagcctcggctgatgattaattaaattgatctttcggctacccgagagaattacatttccaagagacttcttcaccaaaatccagatgggtttacataaacttctgcccacgggtatctcctctctcctaacacgctgtgacgtctgggcttggtggaatctcagggaagcatccgtggggtggaaggtcatcgtctggctcgttgtttgatggttatattaccatgcaattttctttgcctacatttgtattgaatacatcccaatctccttcctattcggtgacatgacacattctatttcagaaggctttgattttatcaagcactttcatttacttctcatggcagtgcctattacttctcttacaatacccatctgtctgctttaccaaaatctatttccccttttcagatcctcccaaatggtcctcataaactgtcctgcctccacctagtggtccaggtatatttccacaatgttacatcaacaggcacttctagccattttccttctcaaaaggtgcaaaaagcaacttcataaacacaaattaaatcttcggtgaggtagtgtgatgctgcttcctcccaactcagcgcacttcgtcttcctcattccacaaaaacccatagccttccttcactctgcaggactagtgctgccaagggttcagctctacctactggtgtgctcttttgagcaagttgcttagcctctctgtaacacaaggacaatagctgcaagcatccccaaagatcattgcaggagacaatgactaaggctaccagagccgcaataaaagtcagtgaattttagcgtggtcctctctgtctctccagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaaggtgcgaaagggccttccgcgcaggcgcagtgcagcagcccgcattcgggattgcgatgcggaatgaatgagttagtggggaagctcgaggggaagaagtgggcggggattctggttcacctctggagccgaaattaaagattagaagcagagaaaagagtgaatggctcagagacaaggccccgaggaaatgagaaaatggggccagggttgcttctttcccctcgatttggaacctgaactgtcttctacccccatatccccgcctttttttcctttttttttttttgaagattatttttactgctggaatacttttgtagaaaaccacgaaagaactttcaaagcctgggaagggctgcatgaaaattcagttcgtctctccagacagcttcggcgcatccttttggtaaggggcttcctcgctttttaaattttctttctttctctacagtcttttttggagtttcgtatatttcttatattttcttattgttcaatcactctcagttttcatctgatgaaaactttatttctcctccacatcagctttttcttctgctgtttcaccattcagagccctctgctaaggttccttttccctcccttttctttcttttgttgtttcacatctttaaatttctgtctctccccagggttgcgtttccttcctggtcagaattcttttctcctttttttttttttttttttttttttttaaacaaacaaacaaaaaacccaaaaaaactctttcccaatttactttcttccaacatgttacaaagccatccactcagtttagaagactctccggccccaccgacccccaacctcgttttgaagccattcactcaatttgcttctctctttctctacagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 116 - protein, 198 aa, Homo sapiens [sequence omitted]

SEQ ID NO: 117 - protein, 198 aa, Mus sp.
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 118 - protein, 198 aa, Canis sp.
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 119 - protein, 199 aa, Bos sp.
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 120 - protein, 239 aa, Rattus sp.
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 121 - protein, 429 aa, Mus sp.
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 122 - protein, 430 aa, Rattus sp.
MGPFCLGCSHRKCYSPIRNLISQETFKFHFKNRLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 123 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 124 - protein, 384 aa, Pan sp.
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 125 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 126 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 127 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 128 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 129 - protein, 395 aa, Rattus sp.
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFWRKKFQKGLCTLWRSGIHVDVMDLPQFADCWTNFVNPQRPFRPWNELEKNSWRIQRRLRRIKESWGL

SEQ ID NO: 130 - protein, 226 aa, Bos sp.
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAERFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 131 - protein, 490 aa, Pan sp.
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 132 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 133 - protein, 190 aa, Gorilla sp.
MNPQIRNPMKAMYPGTFYFQFKNLWEANDRNETWLCFTVEGIKRRSVVSWKTGVFRNQVDSETHCHAERCFLSWECDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 134 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 135 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 136 - protein, 185 aa, Bos sp.
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 137 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 138 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 139 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 140 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 141 - protein, 229 aa, Mus sp.
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 142 - protein, 229 aa, Rattus sp. [sequence omitted]

SEQ ID NO: 143 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 144 - protein, 224 aa, Mus sp.
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 145 - protein, 224 aa, Rattus sp.
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 146 - protein, 224 aa, Bos sp.
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 147 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSFMIQVKILHTTKSPAV

SEQ ID NO: 148 - protein, 381 aa, Artificial Sequence
  Description of Artificial Sequence: Synthetic polypeptide
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKFNYDEFQHCWSKFVYSQRELFEPWNNLPKYYILLHFMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKKHVSLCIFTARIYRRQGRCQEGLRTLAEAGAKISFTYSEFKHCWDTFVDHQGCPFQPWDGLDEHSQDLSGRLRAILQNQEN

SEQ ID NO: 149 - protein, 182 aa, Homo sapiens
MDPPTFTFNFNNEPWWGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISFTYSEFKHCWDTFVDHQGCPFQPWDGLDEHSQDLSGRLRAILQ

SEQ ID NO: 150 - protein, 184 aa, Artificial Sequence
  Description of Artificial Sequence: Synthetic polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISFMTYSEFKHCWDTFVDHQGCPFQPWDGLDEHSQDLSGRLRAILQ

SEQ ID NO: 151 - protein, 167 aa, Unknown
  Description of Unknown: TadA sequence
  MISC_FEATURE (1)..(1): May or may not be present
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 152 - protein, 167 aa, Artificial Sequence
  Description of Artificial Sequence: Synthetic polypeptide
  MISC_FEATURE (1)..(1): May or may not be present
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 153 - protein, 177 aa, Escherichia coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIAQKKAQSSTD

SEQ ID NO: 154 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 155 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 156 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 157 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 158 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 159 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 160 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 161 - protein, 167 aa, Escherichia coli; identical to SEQ ID NO: 152

SEQ ID NO: 162 - protein, 8 aa, Artificial Sequence
  Description of Artificial Sequence: Synthetic peptide
SGGSSGGS

SEQ ID NO: 163 - protein, 4 aa, Artificial Sequence
  Description of Artificial Sequence: Synthetic peptide
GGGS

SEQ ID NO: 164 - protein, 5 aa, Artificial Sequence
  Description of Artificial Sequence: Synthetic peptide
GGGGS

SEQ ID NO: 165 - protein, 5 aa, Artificial Sequence
  Description of Artificial Sequence: Synthetic peptide
EAAAK

SEQ ID NO: 166 - protein, 21 aa, Artificial Sequence
  Description of Artificial Sequence: Synthetic peptide
  MISC_FEATURE (1)..(21): This sequence may encompass 1, 3 or 7 "Gly Gly Ser" repeating units
GGSGGSGGSGGSGGSGGSGGS

SEQ ID NO: 167 - RNA, 20 nt, Artificial Sequence
  Description of Artificial Sequence: Synthetic oligonucleotide
caauggaaguugaacuagcu

SEQ ID NO: 168 - RNA, 20 nt, Artificial Sequence
  Description of Artificial Sequence: Synthetic oligonucleotide
gagcccuggaggaaagacac

SEQ ID NO: 169 - RNA, 20 nt, Artificial Sequence
  Description of Artificial Sequence: Synthetic oligonucleotide
agcaccaggaaagacaaaag

SEQ ID NO: 170 - RNA, 20 nt, Artificial Sequence
  Description of Artificial Sequence: Synthetic oligonucleotide
gacaagaaagggacugaagc

SEQ ID NO: 171 - RNA, 21 nt, Artificial Sequence
  Description of Artificial Sequence: Synthetic oligonucleotide
ugaagagguguccucagucua

SEQ ID NO: 172 - RNA, 22 nt, Artificial Sequence
  Description of Artificial Sequence: Synthetic oligonucleotide
ucugaagagguguccucagucu

SEQ ID NO: 173 - RNA, 20 nt, Artificial Sequence
  Description of Artificial Sequence: Synthetic oligonucleotide
ugguaaggcccugggcaggu

SEQ ID NO: 174 - RNA, 20 nt, Artificial Sequence
  Description of Artificial Sequence: Synthetic oligonucleotide
ugaaagaaauuaaacacaaa

SEQ ID NO: 175 - RNA, 20 nt, Artificial Sequence
  Description of Artificial Sequence: Synthetic oligonucleotide
uuccugcaccgaagcuuugc

SEQ ID NO: 176 - RNA, 20 nt, Artificial Sequence
  Description of Artificial Sequence: Synthetic oligonucleotide
cuugaccaauagccuugaca

SEQ ID NO: 177 - RNA, 20 nt, Artificial Sequence
  Description of Artificial Sequence: Synthetic oligonucleotide
gcuauuggucaaggcaaggc

SEQ ID NO: 178 - RNA, 20 nt, Artificial Sequence
  Description of Artificial Sequence: Synthetic oligonucleotide
cuuccccacacuaucucaau

SEQ ID NO: 179 - RNA, 20 nt, Artificial Sequence
  Description of Artificial Sequence: Synthetic oligonucleotide
auauuugcauugagauagug

SEQ ID NO: 180 - RNA, 20 nt, Artificial Sequence
  Description of Artificial Sequence: Synthetic oligonucleotide
cucuccauguucaggaagua

SEQ ID NO: 181 - RNA, 20 nt, Artificial Sequence
  Description of Artificial Sequence: Synthetic oligonucleotide
agucccccaggccuuucugc

SEQ ID NO: 182 - RNA, 20 nt, Artificial Sequence
  Description of Artificial Sequence: Synthetic oligonucleotide
cuaugcccaaaacugcccca

SEQ ID NO: 183 - RNA, 20 nt, Artificial Sequence
  Description of Artificial Sequence: Synthetic oligonucleotide
ugcccaaaacugccccaaga

SEQ ID NO: 184 - RNA, 20 nt, Artificial Sequence
  Description of Artificial Sequence: Synthetic oligonucleotide
aagguccaacagacuccuga

SEQ ID NO: 185 - RNA, 20 nt, Artificial Sequence
  Description of Artificial Sequence: Synthetic oligonucleotide
agguccaacagacuccugau

SEQ ID NO: 186 - RNA, 20 nt, Artificial Sequence
  Description of Artificial Sequence: Synthetic oligonucleotide
ggaucccagcagaguccaga

SEQ ID NO: 187 - RNA, 20 nt, Artificial Sequence
  Description of Artificial Sequence: Synthetic oligonucleotide
gaucccagcagaguccagau

SEQ ID NO: 188 - RNA, 20 nt, Artificial Sequence
  Description of Artificial Sequence: Synthetic oligonucleotide
gcagcacagaugaaucagag

SEQ ID NO: 189 - RNA, 20 nt, Artificial Sequence
  Description of Artificial Sequence: Synthetic oligonucleotide
cagcacagaugaaucagaga

SEQ ID NO: 190 - RNA, 20 nt, Artificial Sequence
  Description of Artificial Sequence: Synthetic oligonucleotide
augaaucagagaggcagcag

SEQ ID NO: 191 - RNA, 20 nt, Artificial Sequence
  Description of Artificial Sequence: Synthetic oligonucleotide
ugagcuucaggaggaugugc

SEQ ID NO: 192 - RNA, 20 nt, Artificial Sequence
  Description of Artificial Sequence: Synthetic oligonucleotide
gagcuucaggaggaugugca

SEQ ID NO: 193 - RNA, 20 nt, Artificial Sequence
  Description of Artificial Sequence: Synthetic oligonucleotide
gaugugcaggaaaugaaugc

SEQ ID NO: 194 - RNA, 20 nt, Artificial Sequence
  Description of Artificial Sequence: Synthetic oligonucleotide
ugugcaggaaaugaaugccg

SEQ ID NO: 195 - RNA, 20 nt, Artificial Sequence
  Description of Artificial Sequence: Synthetic oligonucleotide
cuuacucucacuggccggag

SEQ ID NO: 196 - RNA, 20 nt, Artificial Sequence
  Description of Artificial Sequence: Synthetic oligonucleotide
acuuacucucacuggccgga

SEQ ID NO: 197 - RNA, 20 nt, Artificial Sequence
  Description of Artificial Sequence: Synthetic oligonucleotide
cacuuacucucacuggccgg

SEQ ID NO: 198 - RNA, 20 nt, Artificial Sequence
  Description of Artificial Sequence: Synthetic oligonucleotide
ugacacuuacucucacuggc

SEQ ID NO: 199 - RNA, 20 nt, Artificial Sequence
  Description of Artificial Sequence: Synthetic oligonucleotide
uugucuucugagggaggaaa

SEQ ID NO: 200 - RNA, 20 nt, Artificial Sequence
  Description of Artificial Sequence: Synthetic oligonucleotide
cucagaagacaaaacugcua

SEQ ID NO: 201 - RNA, 20 nt, Artificial Sequence
  Description of Artificial Sequence: Synthetic oligonucleotide
ucaucucuuaccuuuccuca

SEQ ID NO: 202 - RNA, 20 nt, Artificial Sequence
  Description of Artificial Sequence: Synthetic oligonucleotide
cacacuuaccauccauugaa

SEQ ID NO: 203 - RNA, 20 nt, Artificial Sequence
  Description of Artificial Sequence: Synthetic oligonucleotide
cucaggggcggugugcccac

SEQ ID NO: 204 - RNA, 20 nt, Artificial Sequence
  Description of Artificial Sequence: Synthetic oligonucleotide
cuccucccaggcaaagccuu

SEQ ID NO: 205 - RNA, 20 nt, Artificial Sequence
  Description of Artificial Sequence: Synthetic oligonucleotide
guggggaaggggcccccaag

SEQ ID NO: 206 - RNA, 20 nt, Artificial Sequence
  Description of Artificial Sequence: Synthetic oligonucleotide
auugagauaguguggggaag

SEQ ID NO: 207 - RNA, 20 nt, Artificial Sequence
  Description of Artificial Sequence: Synthetic oligonucleotide
cauugagauaguguggggaa

SEQ ID NO: 208 - RNA, 20 nt, Artificial Sequence
  Description of Artificial Sequence: Synthetic oligonucleotide
gcauugagauagugugggga

SEQ ID NO: 209 - RNA, 20 nt, Artificial Sequence
  Description of Artificial Sequence: Synthetic oligonucleotide
caaggcuauuggucaaggca

SEQ ID NO: 210 - RNA, 20 nt, Artificial Sequence
  Description of Artificial Sequence: Synthetic oligonucleotide
cuugucaaggcuauugguca

SEQ ID NO: 211 - RNA, 20 nt, Artificial Sequence
  Description of Artificial Sequence: Synthetic oligonucleotide
guuugccuugucaaggcuau

SEQ ID NO: 212 - RNA, 20 nt, Artificial Sequence
  Description of Artificial Sequence: Synthetic oligonucleotide
uggucaaguuugccuuguca

SEQ ID NO: 213 - RNA, 20 nt, Artificial Sequence
  Description of Artificial Sequence: Synthetic oligonucleotide
uggggaaggggcccccaaga

SEQ ID NO: 214 - RNA, 20 nt, Artificial Sequence
  Description of Artificial Sequence: Synthetic oligonucleotide
guguggggaaggggccccca

SEQ ID NO: 215 - RNA, 20 nt, Artificial Sequence
  Description of Artificial Sequence: Synthetic oligonucleotide
ucagacagauauuugcauug

SEQ ID NO: 216 - RNA, 20 nt, Artificial Sequence
  Description of Artificial Sequence: Synthetic oligonucleotide
uuucagacagauauuugcau

SEQ ID NO: 217 - RNA, 20 nt, Artificial Sequence
  Description of Artificial Sequence: Synthetic oligonucleotide
cuugccuugaccaauagccu

SEQ ID NO: 218 - RNA, 20 nt, Artificial Sequence
  Description of Artificial Sequence: Synthetic oligonucleotide
uagccuugacaaggcaaacu

SEQ ID NO: 219 - RNA, 20 nt, Artificial Sequence
  Description of Artificial Sequence: Synthetic oligonucleotide
caaacuugaccaauagucuu

SEQ ID NO: 220 - RNA, 20 nt, Artificial Sequence
  Description of Artificial Sequence: Synthetic oligonucleotide
uguggggaaggggcccccaa

SEQ ID NO: 221 - RNA, 20 nt, Artificial Sequence
  Description of Artificial Sequence: Synthetic oligonucleotide
gggccccuuccccacacuau

SEQ ID NO: 222 - RNA, 20 nt, Artificial Sequence
  Description of Artificial Sequence: Synthetic oligonucleotide
cagacagauauuugcauuga

SEQ ID NO: 223 - RNA, 20 nt, Artificial Sequence
  Description of Artificial Sequence: Synthetic oligonucleotide
aaguuugccuugucaaggcu

SEQ ID NO: 224 - RNA, 20 nt, Artificial Sequence
  Description of Artificial Sequence: Synthetic oligonucleotide
gccuugacaaggcaaacuug

SEQ ID NO: 225 - RNA, 20 nt, Artificial Sequence
  Description of Artificial Sequence: Synthetic oligonucleotide
uugacaaggcaaacuugacc

SEQ ID NO: 226 - RNA, 20 nt, Artificial Sequence
  Description of Artificial Sequence: Synthetic oligonucleotide
ugaccaauagucuuagagua

SEQ ID NO: 227 - RNA, 23 nt, Artificial Sequence
  Description of Artificial Sequence: Synthetic oligonucleotide
agacagauauuugcauugagaua

SEQ ID NO: 228 - RNA, 20 nt, Artificial Sequence
  Description of Artificial Sequence: Synthetic oligonucleotide
cagaugcgaaagaaacgagu

SEQ ID NO: 229 - protein, 104 aa, Artificial Sequence
  Description of Artificial Sequence: Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 230 - DNA, 20 bp, Unknown
  Description of Unknown: Target sequence
tccacaggagtcagatgcac

SEQ ID NO: 231 - DNA, 21 bp, Unknown
  Description of Unknown: Target sequence
tgaagaggtgtcctcagtcta

SEQ ID NO: 232 - DNA, 22 bp, Unknown
  Description of Unknown: Target sequence
tctgaagaggtgtcctcagtct

SEQ ID NO: 233 - DNA, 20 bp, Unknown
  Description of Unknown: Target sequence
tggtaaggccctgggcaggt

SEQ ID NO: 234 - protein, 5 aa, Artificial Sequence
  Description of Artificial Sequence: Synthetic peptide
QSGTL

SEQ ID NO: 235 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDEGADKRTADGSEFESPKKKRKV

SEQ ID NO: 236 - RNA, 101 nt, Artificial Sequence
  Description of Artificial Sequence: Synthetic polynucleotide
gacuucuccacaggagucagaguuuuagagcuagaaauagcaaguuaaaauaaggcuaguccguuaucaacuugaaaaaguggcaccgagucggugcuuuu

SEQ ID NO: 237 - DNA, 5361 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaaatacggcggctttatgcagcccaccgtggcctattctgttctggtggtggccaaagtggaaaagggcaagtccaagaaactcaagagcgtgaaagagctgctggggatcaccatcatggaaagaagcagcttcgagaagaatccgatcgatttcctcgaggccaagggttacaaagaagtgaaaaaggacctgatcatcaagctccccaagtactccctgttcgagctggaaaacggccggaagagaatgctggcctctgccaagttcctgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctagagccttcaagtactttgacaccaccatcgcccggaaggagtaccggtccaccaaagaggtgctggacgccactctgatccaccagtctatcaccggcctgtacgagacacggatcgacctgtctcaactcggaggcgacgaaggcgccgataagagaaccgccgatggctctgagttcgagagccctaagaaaaagcgcaaagtgtag

SEQ ID NO: 238 - DNA, 23 bp, Artificial Sequence
  Description of Artificial Sequence: Synthetic oligonucleotide
cttgaccaatagccttgacaagg

SEQ ID NO: 239 - DNA, 20 bp, Artificial Sequence
  Description of Artificial Sequence: Synthetic oligonucleotide
caaggctattggtcaaggca

SEQ ID NO: 240 - DNA, 20 bp, Artificial Sequence
  Description of Artificial Sequence: Synthetic oligonucleotide
gctattggtcaaggcaaggc

SEQ ID NO: 241 - DNA, 23 bp, Artificial Sequence
  Description of Artificial Sequence: Synthetic oligonucleotide
cttgccttgaccaatagccttga

SEQ ID NO: 242 - DNA, 23 bp, Artificial Sequence
  Description of Artificial Sequence: Synthetic oligonucleotide
tcagacagatatttgcattgaga

SEQ ID NO: 243 - DNA, 23 bp, Artificial Sequence
  Description of Artificial Sequence: Synthetic oligonucleotide
tttcagacagatatttgcattga

SEQ ID NO: 244 - DNA, 23 bp, Artificial Sequence
  Description of Artificial Sequence: Synthetic oligonucleotide
tagccttgacaaggcaaacttga

SEQ ID NO: 245 - DNA, 26 bp, Artificial Sequence
  Description of Artificial Sequence: Synthetic oligonucleotide
aagtttgccttgtcaaggctattggt

SEQ ID NO: 246 - RNA, 80 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugcuuuu

SEQ ID NO: 247 - RNA, 21 nt, Artificial Sequence
  Description of Artificial Sequence: Synthetic oligonucleotide
cuccacaggagucagaugcac

SEQ ID NO: 248 - DNA, 28 bp, Homo sapiens
atcgacaagaaagggactgaagctgctg

SEQ ID NO: 249 - protein, 9 aa, Homo sapiens
IDKKGTEAA

SEQ ID NO: 250 - DNA, 26 bp, Homo sapiens
tccacaggagtcagatgcaccatggt

SEQ ID NO: 251 - DNA, 24 bp, Homo sapiens
acttctccacaggagtcagatgca

SEQ ID NO: 252 - DNA, 23 bp, Homo sapiens
cagacttctccacaggagtcaga

SEQ ID NO: 253 - DNA, 26 bp, Homo sapiens
ggcagacttctccacaggagtcagat

SEQ ID NO: 254 - DNA, 33 bp, Homo sapiens
taccacgtagactgaggacacctcttcagacgg

SEQ ID NO: 255 - DNA, 39 bp, Homo sapiens
accatggtgcatctgactcctgtggagaagtctgccgtt

SEQ ID NO: 256 - protein, 13 aa, Homo sapiens
TMVHLTPVEKSAV

SEQ ID NO: 257 - protein, 5 aa, Artificial Sequence
  Description of Artificial Sequence: Synthetic peptide
HPTPA

SEQ ID NO: 258 - DNA, 26 bp, Homo sapiens
ttctagggtgatgtatgaatggaatc

SEQ ID NO: 259 - DNA, 26 bp, Homo sapiens
  modified_base (21)..(22): a, c, t, g, unknown or other
gctgaatgaagttatgatcgnnagaa

SEQ ID NO: 260 - DNA, 26 bp, Homo sapiens
  modified_base (5)..(6): a, c, t, g, unknown or other
tggtnntgtgtgactacagtgggggc

SEQ ID NO: 261 - DNA, 27 bp, Homo sapiens
  modified_base (5)..(6): a, c, t, g, unknown or other
tggtnncaggatttgtctttacttgtc

SEQ ID NO: 262 - protein, 8 aa, Homo sapiens
  MOD_RES (6)..(6): Val or Ala
VHLTPXEK

SEQ ID NO: 263 - DNA, 27 bp, Homo sapiens
tggtgcatctgactcctgtggagaagt

SEQ ID NO: 264 - protein, 8 aa, Homo sapiens
  MOD_RES (5)..(5): Val or Ala
  MOD_RES (8)..(8): Ser or Pro
HLTPXEKX

SEQ ID NO: 265 - DNA, 25 bp, Homo sapiens
gcatctgactcctgtggagaagtct

SEQ ID NO: 266 - DNA, 226 bp, Homo sapiens
ggcaaaggctataaaaaaaattagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagc

SEQ ID NO: 267 - protein, 1368 aa, Artificial Sequence [sequence omitted]

SEQ ID NO: 268 - DNA, 24 bp, Homo sapiens
cacgtggactgaggactcctcttc

SEQ ID NO: 269 - RNA, 24 nt, Homo sapiens
gugcaccugacuccugaggagaag

SEQ ID NO: 270 - protein, 8 aa, Homo sapiens
VHLTPEEK

SEQ ID NO: 271 - DNA, 24 bp, Homo sapiens
cacgtggactgaggacacctcttc

SEQ ID NO: 272 - RNA, 24 nt, Homo sapiens
gugcaccugacuccuguggagaag

SEQ ID NO: 273 - protein, 8 aa, Homo sapiens
VHLTPVEK

SEQ ID NO: 274 - DNA, 24 bp, Homo sapiens
cacgtggactgaggattcctcttc

SEQ ID NO: 275 - RNA, 24 nt, Homo sapiens
gugcaccugacuccuaaggagaag

SEQ ID NO: 276 - protein, 8 aa, Homo sapiens
VHLTPKEK

SEQ ID NO: 277 - DNA, 24 bp, Homo sapiens
cacgtggactgaggacgcctcttc

What is claimed is:

1. A method of editing a β-globin (HBB) polynucleotide comprising a single nucleotide polymorphism (SNP) associated with sickle cell disease, wherein the SNP associated with sickle cell disease results in expression of an HBB polypeptide having a valine at amino acid position 7 of SEQ ID NO: 37, the method comprising contacting the HBB polynucleotide with a base editor in complex with one or more single guide RNAs (sgRNAs), wherein the base editor comprises a *Streptococcus pyogenes* Cas9 polynucleotide programmable DNA binding domain having specificity for a protospacer-adjacent motif comprising the nucleic acid sequence 5'-NGC-3' and an adenosine deaminase domain, wherein the one or more guide polynucleotides target the base editor to effect an A•T to G•C alteration of the SNP associated with sickle cell disease, thereby substituting an alanine for the valine at amino acid position 7 referenced to SEQ ID NO: 37, wherein the first and the last three bases of the one or more sgRNAs are phosphorothioate and 2'-O-methyl modified, and wherein the one or more sgRNAs comprise a spacer complementary to an HBB nucleic acid sequence corresponding to the target sequence ACTTCTCCACAGGAGTCAGA (positions 1-20 of SEQ ID NO: 251) and adjacent to a protospacer-adjacent motif comprising the nucleic acid sequence 5'-NGC-3'.

2. The method of claim 1, wherein the polynucleotide programmable DNA binding domain is a nuclease inactive or nickase variant.

3. The method of claim 2, wherein the nickase variant comprises a D10A amino acid substitution referenced to SEQ ID NO: 47.

4. The method of claim 1, wherein the adenosine deaminase comprises an amino acid sequence having at least 85% identity to the following amino acid sequence:

SEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRI

GRVVFGARDAKTGAAGSLMDVLHHPGMNHRVEITEGILADECAALLSDF

FRMRRQEIKAQKKAQSSTD (positions 2-167 of SEQ ID NO: 151).

* * * * *